United States Patent
Walensky et al.

(10) Patent No.: US 12,358,960 B2
(45) Date of Patent: Jul. 15, 2025

(54) SELECTIVE TARGETING OF UBIQUITIN- AND UBIQUITIN-LIKE E1-ACTIVATING ENZYMES BY STRUCTURALLY-STABILIZED PEPTIDES

(71) Applicant: Dana-Farber Cancer Institute, Inc., Boston, MA (US)

(72) Inventors: Loren D. Walensky, Newton, MA (US); Ann Morgan Cathcart, Cambridge, MA (US); Gregory H. Bird, Pelham, NH (US)

(73) Assignee: Dana-Farber Cancer Institute, Inc., Boston, MA (US)

( * ) Notice: Subject to any disclaimer, the term of this patent is extended or adjusted under 35 U.S.C. 154(b) by 829 days.

(21) Appl. No.: 17/600,468

(22) PCT Filed: Apr. 17, 2020

(86) PCT No.: PCT/US2020/028840
§ 371 (c)(1),
(2) Date: Sep. 30, 2021

(87) PCT Pub. No.: WO2020/215005
PCT Pub. Date: Oct. 22, 2020

(65) Prior Publication Data
US 2022/0169688 A1    Jun. 2, 2022

Related U.S. Application Data

(60) Provisional application No. 62/835,721, filed on Apr. 18, 2019.

(51) Int. Cl.
*C07K 14/47* (2006.01)
*A61K 38/00* (2006.01)

(52) U.S. Cl.
CPC .......... *C07K 14/4703* (2013.01); *A61K 38/00* (2013.01)

(58) Field of Classification Search
CPC ..................... C07K 14/4703; A61K 38/00
See application file for complete search history.

(56) References Cited

U.S. PATENT DOCUMENTS

| | | |
|---|---|---|
| 5,446,090 A | 8/1995 | Harris |
| 6,348,558 B1 | 2/2002 | Harris et al. |
| 7,723,468 B2 | 5/2010 | Daffre et al. |
| 8,889,632 B2 | 11/2014 | Bernal et al. |
| 9,278,067 B2 | 3/2016 | Boulikas |
| 2003/0072794 A1 | 4/2003 | Boulikas |
| 2005/0250680 A1 | 11/2005 | Walensky et al. |
| 2010/0168388 A1 | 7/2010 | Bernal et al. |
| 2010/0286057 A1 | 11/2010 | Walensky et al. |
| 2012/0172285 A1 | 7/2012 | Walensky et al. |
| 2014/0134232 A1 | 5/2014 | Boulikas |

FOREIGN PATENT DOCUMENTS

| | | |
|---|---|---|
| JP | H9-508263 | 8/1997 |
| JP | 2002536417 | 10/2002 |
| JP | 2007513878 | 5/2007 |
| JP | 2009528986 | 8/2009 |
| JP | 2010516254 | 5/2010 |
| WO | WO 1995/018974 | 7/1995 |
| WO | WO 99/14259 | 3/1999 |
| WO | WO 99/34833 | 7/1999 |
| WO | WO 2000/047220 | 8/2000 |
| WO | WO 2001/93836 | 12/2001 |
| WO | WO 2005/047476 | 5/2005 |
| WO | WO 2007/059356 | 5/2007 |
| WO | WO 2007/092213 | 8/2007 |
| WO | WO 2008/089329 | 7/2008 |
| WO | WO 2008/121767 | 10/2008 |
| WO | WO 2010/060112 | 5/2010 |
| WO | WO 2010/068684 | 6/2010 |
| WO | WO 2010/148335 | 12/2010 |
| WO | WO 2017/109494 | 6/2017 |
| WO | WO 2017/147283 | 8/2017 |
| WO | WO 2018/112226 | 6/2018 |

OTHER PUBLICATIONS

Drumm et al, Genetic Variation and Clinical Heterogeneity in Cystic Fibrosis, Annu. Rev. Pathol. Mech. Dis., 2012, 7, pp. 267-282.*
Yampolsky et al, The Exchangeability of Amino Acids in Proteins, Genetics, 2005, 170, pp. 1459-1472.*
Altschul et al., "Gapped BLAST and PSI-BLAST: a new generation of protein database search programs," Nucleic Acids Res., Sep. 1, 1997, 25(17):3389-402.
Araghi et al., "Designing helical peptide inhibitors of protein-protein interactions. Current opinion in structural biology," Aug. 1, 2016, 39:27-38.
Balaram "Non-standard amino acids in peptide design and protein engineering," Current Opinion in Structural Biology, Jan. 1, 1992, 2(6):845-51.
Barclay et al., "Inhibition of Pro-apoptotic BAX by a noncanonical interaction mechanism," Molecular cell, Mar. 5, 2015, 57(5):873-86.
Barghout et al., "Preclinical evaluation of the selective small-molecule UBA1 inhibitor, TAK-243, in acute myeloid leukemia," Leukemia, Jan. 2019, 33(1):37-51.
Bird et al., "Chemical Synthesis of Hydrocarbon-Stapled Peptides for Protein Interaction Research and Therapeutic Targeting," Current protocols in chemical biology, Sep. 2011, 3(3):99-117.

(Continued)

*Primary Examiner* — Li N Komatsu
(74) *Attorney, Agent, or Firm* — Fish & Richardson P.C.

(57) ABSTRACT

This disclosure features structurally-stabilized and/or warhead-bearing structurally stabilized peptide inhibitors for targeting ubiquitin activating enzymes (E1). Also disclosed are methods of using such structurally-stabilized and warhead-bearing structurally stabilized peptides in the treatment of E1-expressing or -dependent cancers or diseases. Also provided are combination therapies comprising such structurally-stabilized and/or warhead-bearing structurally stabilized peptide for the treatment of E1-expressing or -dependent diseases.

28 Claims, 24 Drawing Sheets
Specification includes a Sequence Listing.

(56) References Cited

OTHER PUBLICATIONS

Bird et al., "Synthesis and Biophysical Characterization of Stabilized α-Helices of BCL-2 Domains," Methods in enzymology, Jan. 2008, 446:369-86.
Blackwell et al., "Highly efficient synthesis of covalently cross-linked peptide helices by ring-closing metathesis," Angewandte Chemie International Edition, Dec. 17, 1998, 37(23):3281-4.
Blackwell et al., "Ring-closing metathesis of olefinic peptides: design, synthesis, and structural characterization of macrocyclic helical peptides," The Journal of organic chemistry, Aug. 10, 2001, 66(16):5291-302.
Brunel et al., "Synthesis of constrained helical peptides by thioether ligation: application to analogs of gp41," Chemical communications, 2005, (20):2552-4.
Chapman et al., "A highly stable short α-helix constrained by a main-chain hydrogen-bond surrogate," Journal of the American Chemical Society, Oct. 6, 2004, 126(39):12252-3.
Chin et al., "Design and Evolution of a Miniature Bcl-2 Binding Protein," Angew Chem Int Ed Engl. Oct. 15, 2001, 40(20):3806-3809.
Cromm et al., "Hydrocarbon stapled peptides as modulators of biological function," ACS chemical biology, Jun. 19, 2015, 10(6):1362-75.
Devi et al., "Antibodies to poly [2-8)-ax-N-acetylneuraminic acid] are elicited by immunization of mice with *Escherichia coli* K92 conjugates: potential vaccines for groups B and C meningococci and *E. coli* K1," Proc. Natl. Acad. Sci. USA, 1991, 88:7175-9.
EBI Accession No. AX359331, Sequence 301 from Patent WO0193836, Feb. 13, 2002, 2 pages.
Fattom et al., "Serum antibody response in adult volunteers elicited by injection of *Streptococcus pneumoniae* type 12F polysaccharide alone or conjugated to diphtheria toxoid," Infection and immunity, Jul. 1990, 58(7):2309-12.
GenBank Accession No. AOL83109.1, "Sequence 301 from U.S. Pat. No. 9,278,067," Sep. 7, 2016, 1 page.
Gunnoo et al., "Bioconjugation-using selective chemistry to enhance the properties of proteins and peptides as therapeutics and carriers," Organic & biomolecular chemistry, 2016, 14(34):8002-13.
Haas et al., "Functional diversity among putative E2 isozymes in the mechanism of ubiquitin-histone ligation," Journal of Biological Chemistry, Sep. 15, 1988, 263(26):13268-75.
Haney et al., "Promoting peptide α-helix formation with dynamic covalent oxime side-chain cross-links," Chemical communications, 2011, 47(39):10915-7.
He et al., "Probing the roles of SUMOylation in cancer cell biology by using a selective SAE inhibitor," Nature chemical biology, Nov. 2017, 13(11):1164-71.
Hilinski et al., "Stitched α-helical peptides via bis ring-closing metathesis," Journal of the American Chemical Society, Sep. 3, 2014, 136(35):12314-22.
Hochstrasser, "Origin and function of ubiquitin-like proteins," Nature, Mar. 2009, 458(7237):422-9.
Horne et al., "Sequence-based design of alpha/beta-peptide foldamers that mimic BH3 domains," Angew Chem Int Ed Engl. 2008, 47(15):2853-6.
Hyer et al., "A small-molecule inhibitor of the ubiquitin activating enzyme for cancer treatment," Nature medicine, Feb. 2018, 24(2):186-93.
International Preliminary Report on Patentability in International Appln. No. PCT/US2020/028840, dated Oct. 28, 2021, 16 pages.
International Search Report and Written Opinion in International Appln. No. PCT/US2020/028840, dated Aug. 31, 2020, 28 pages.
Jackson et al., "General approach to the synthesis of short. alpha.-helical peptides," Journal of the American Chemical Society, Nov. 1991, 113(24):9391-2.
Jin et al., "Dual E1 activation systems for ubiquitin differentially regulate E2 enzyme charging," Nature, Jun. 2007, 447(7148):1135-8.
Kawamoto et al., "Design of triazole-stapled BCL9 α-helical peptides to target the β-catenin/B-cell CLL/lymphoma 9 (BCL9) protein-protein interaction," Journal of medicinal chemistry, Feb. 9, 2012, 55(3):1137-46.
Kemp et al., "The structure and energetics of helix formation by short templated peptides in aqueous solution. 2. Characterization of the helical structure of Ac-Hell-Ala6-OH," Journal of the American Chemical Society, May 8, 1996, 118(18):4240-8.
Krishnamurty et al., "Biochemical mechanisms of resistance to small-molecule protein kinase inhibitors," ACS chemical biology, Jan. 15, 2010 5(1):121-38.
Kumita et al., "Photo-control of helix content in a short peptide," Proceedings of the National Academy of Sciences, Apr. 11, 2000, 97(8):3803-8.
Lau et al., "Functionalised staple linkages for modulating the cellular activity of stapled peptides," Chemical Science, 2014, 5(5):1804-9.
Lau et al., "Peptide stapling techniques based on different macrocyclisation chemistries," Chemical Society Reviews, 2015, 44(1):91-102.
Li et al., "Allosteric inhibition of ubiquitin-like modifications by a class of inhibitor of SUMO-activating enzyme," Cell chemical biology, Feb. 21, 2019, 26(2):278-88.
Lv et al., "S. pombe Ubal-Ubc15 structure reveals a novel regulatory mechanism of ubiquitin E2 activity," Molecular cell, Feb. 16, 2017, 65(4):699-714.
Madden et al., "Facile synthesis of stapled, structurally reinforced peptide helices via a photoinduced intramolecular 1, 3-dipolar cycloaddition reaction," Chemical communications, 2009, (37):5588-90.
Madden et al., "Synthesis of cell-permeable stapled peptide dual inhibitors of the p53-Mdm2/Mdmx interactions via photoinduced cycloaddition," Bioorg. Med Chem Lett., 2011, 21:1472-5.
Milhollen et al., "Treatment-emergent mutations in NAEβ B confer resistance to the NEDD8-activating enzyme inhibitor MLN4924," Cancer cell, Mar. 20, 2012, 21(3):388-401.
Misra et al., "Dissecting the specificity of adenosyl sulfamate inhibitors targeting the ubiquitin-activating enzyme," Structure, Jul. 5, 2017, 25(7):1120-9.
Olsen et al., "Active site remodelling accompanies thioester bond formation in the SUMO E1," Nature, Feb. 2010, 463(7283):906-12.
Olsen et al., "Structure of a ubiquitin E1-E2 complex: insights to E1-E2 thioester transfer," Molecular cell, Mar. 7, 2013, 49(5):884-96.
Orner et al., "Toward proteomimetics: terphenyl derivatives as structural and functional mimics of extended regions of an α-helix," Journal of the American Chemical Society, Jun. 6, 2001, 123(22):5382-3.
Phelan et al., "A general method for constraining short peptides to an α-helical conformation," Journal of the American Chemical Society, Jan. 22, 1997, 119(3):455-60.
Schafmeister et al., "An all-hydrocarbon cross-linking system for enhancing the helicity and metabolic stability of peptides," Journal of the American Chemical Society, Jun. 21, 2000, 122(24):5891-2.
Shepherd et al., "Single turn peptide alpha helices with exceptional stability in water," Journal of the American Chemical Society, Mar. 9, 2005, 127(9):2974-83.
Soucy et al., "An inhibitor of NEDD8-activating enzyme as a new approach to treat cancer," Nature, Apr. 2009, 458(7239):732-6.
Spokoyny et al., "A perfluoroaryl-cysteine SNAr chemistry approach to unprotected peptide stapling," Journal of the American Chemical Society, Apr. 24, 2013, 135(16):5946-9.
Szu et al., "Comparative immunogenicities of Vi polysaccharide-protein conjugates composed of cholera toxin or its B subunit as a carrier bound to high-or lower-molecular-weight Vi," Infection and Immunity, Dec. 1989, 57(12):3823-7.
Szu et al., "Laboratory and preliminary clinical characterization of Vi capsular polysaccharide-protein conjugate vaccines," Infection and immunity, Oct. 1994, 62(10):4440-4.
Szu et al., "Relation between structure and immunologic properties of the Vi capsular polysaccharide," Infection and immunity, Dec. 1991, 59(12):4555-61.
Szu et al., "Vi capsular polysaccharide-protein conjugates for prevention of typhoid fever. Preparation, characterization, and

(56) References Cited

OTHER PUBLICATIONS immunogenicity in laboratory animals," The Journal of experimental medicine, Nov. 1987, 166(5):1510-24.
Tokgöz et al., "E1-E2 interactions in ubiquitin and Nedd8 ligation pathways," Journal of Biological Chemistry, Jan. 2, 2012, 287(1):311-21.
Toth et al., "A gatekeeper residue for NEDD8-activating enzyme inhibition by MLN4924," Cell reports. Apr. 19, 2012 1(4):309-16.
Walensky et al., "Activation of apoptosis in vivo by a hydrocarbon-stapled BH3 helix," Science, Sep. 3, 2004, 305(5689):1466-70.
Walensky et al., "Hydrocarbon-stapled peptides: principles, practice, and progress: miniperspective," Journal of medicinal chemistry, Aug. 14, 2014, 57(15):6275-88.
Williams et al., "Asymmetric synthesis of monosubstituted and. alpha.,. alpha.-disubstituted. alpha.-amino acids via diastereoselective glycine enolate alkylations," Journal of the American Chemical Society, Nov. 1991, 113(24):9276-86.
Williams et al., "Efficient Asymmetric Synthesis of N-tert-Butoxycarbonyl α-Aminoacids Using 4-tert-Butoxycarbonyl-5,6-Diphenylmorpholin-2-one:(R)-(N-tert-Butoxycarbonyl)Allylglycine: (4-Pentenoic Acid, 2-[[(1, 1-Dimethylethoxy) carbonyl] amino]-,(2 R)-)," Organic syntheses, Apr. 28, 2003, 80:31-7.
Xu et al., "Mutations in UBA3 confer resistance to the NEDD8-activating enzyme inhibitor MLN4924 in human leukemic cells," PloS one, Apr. 1, 2014, 9(4):e93530, 10 pages.
Xu et al., "Targeting the ubiquitin E1 as a novel anti-cancer strategy," Current pharmaceutical design, Jun. 1, 2013, 19(18):3201-9.
Yang et al., "[11] Calculation of protein conformation from circular dichroism," in Methods in Enzymology, Academic press, Jan. 1986, 130:208-269.
Young et al., "Beyond the canonical 20 amino acids: expanding the genetic lexicon," Journal of Biological Chemistry, Apr. 9, 2010, 285(15):11039-44.
Cathcart et al., "Targeting a helix-in-groove interaction between E1 and E2 blocks ubiquitin transfer," Nature Chemical Biology, Nov. 2020, 16(11):1218-1226.
ClinicalTrials.gov [online], "TAK-243 in Treating Patients With Relapsed or Refractory Acute Myeloid Leukemia or Myelodysplastic Syndromes With Increased Blasts," NCT03816319, Mar. 12, 2025, last updated Mar. 17, 2025, retrieved from URL<https://clinicaltrials.gov/study/NCT03816319>, 20 pages.
Huhn et al., "Selective Covalent Targeting of Anti-Apoptotic BFL-1 by Cysteine-Reactive Stapled Peptide Inhibitors," Cell Chemical Biology, Sep. 2016, 23(9):1123-1134.
Lv et al., "Crystal structure of a human ubiquitin E1-ubiquitin complex reveals conserved functional elements essential for activity," Journal of Biological Chemistry, Nov. 2018, 293(47):18337-18352.
GenBank Accession No. CAA22354.2, "ubiquitin activating enzyme E1 Uba1 [Schizosaccharomyces pombe], " Feb. 27, 2015, 2 pages.
Huang et al., "E2-RING Expansion of the NEDD8 Cascade Confers Specificity to Cullin Modification," Mol. Cell., Feb. 27, 2009, 33(4):483-495.
Huang et al., "Structural Basis for Recruitment of Ubc12 by an E2 Binding Domain in NEDD8's E1," Mol. Cell., Feb. 4, 2005, 17(3):341-350.
Wang et al., "Crystal Structure of UBA2$^{ufd}$ -Ubc9: Insights into E1-E2 Interactions in Sumo Pathways," PLoS One, Dec. 30, 2010, 5(12):e15805, 11 pages.

\* cited by examiner

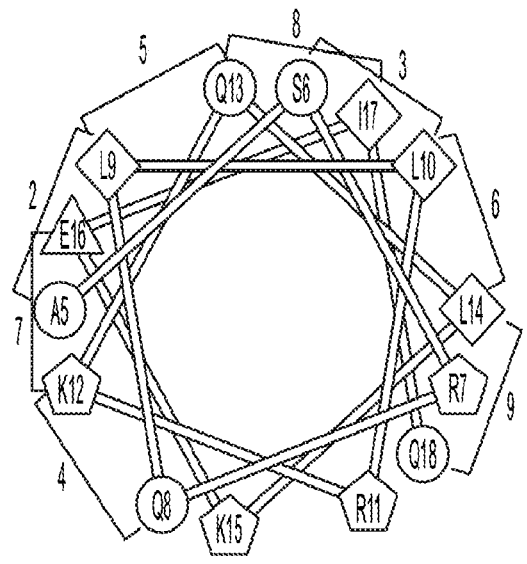 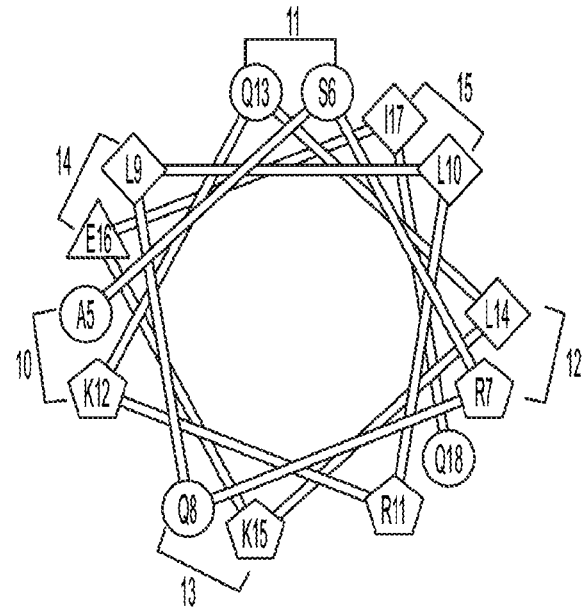
FIG. 1B  FIG. 1C
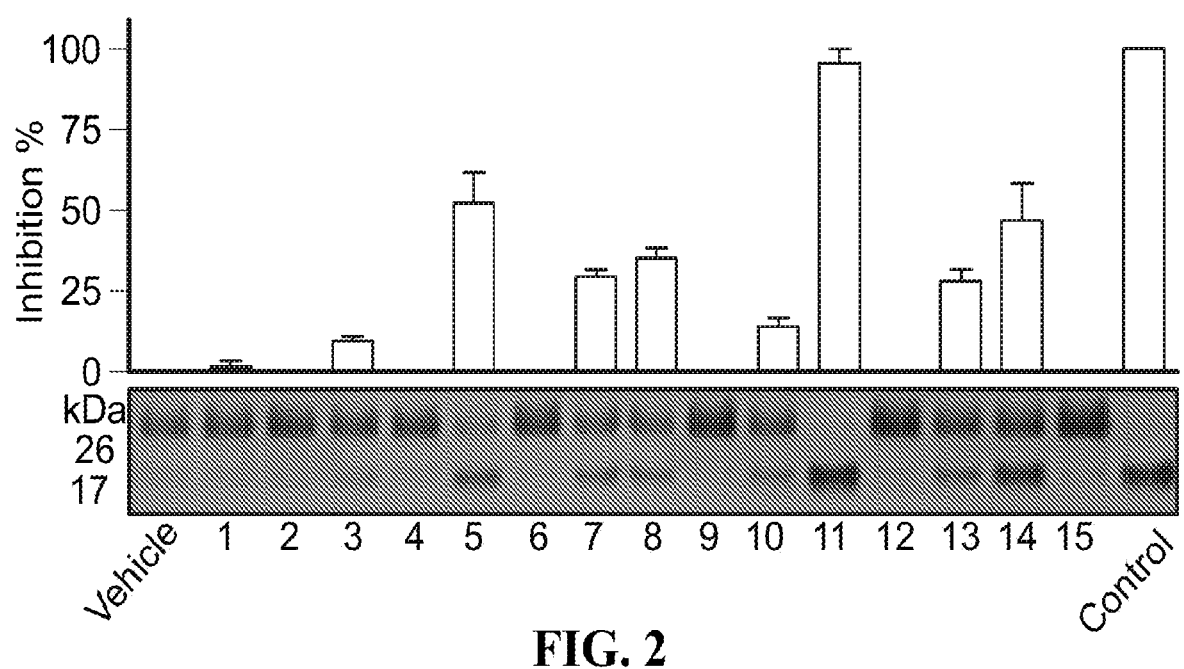
FIG. 2

| | | |
|---:|:---|:---|
| UBE2A[h1] | $^1$MSTPARRRLMRDFKRLQ$^{17}$ | (SEQ ID NO: 1321) |
| SAH-UBE2A | Ac-BSTP8RRRLBRXFKRLQ-NH2 | (SEQ ID NO: 132) |
| B1A | Ac-ASTP8RRRLBRXFKRLQ-NH2 | (SEQ ID NO: 1322) |
| S2A | Ac-BATP8RRRLBRXFKRLQ-NH2 | (SEQ ID NO: 1323) |
| T3A | Ac-BSAP8RRRLBRXFKRLQ-NH2 | (SEQ ID NO: 1324) |
| P4A | Ac-BSTA8RRRLBRXFKRLQ-NH2 | (SEQ ID NO: 1325) |
| R6A | Ac-BSTP8ARRLBRXFKRLQ-NH2 | (SEQ ID NO: 1326) |
| R7A | Ac-BSTP8RARLBRXFKRLQ-NH2 | (SEQ ID NO: 1327) |
| R8A | Ac-BSTP8RRALBRXFKRLQ-NH2 | (SEQ ID NO: 1328) |
| L9A | Ac-BSTP8RRRABRXFKRLQ-NH2 | (SEQ ID NO: 1329) |
| B10A | Ac-BSTP8RRRLARXFKRLQ-NH2 | (SEQ ID NO: 1330) |
| R11A | Ac-BSTP8RRRLBAXFKRLQ-NH2 | (SEQ ID NO: 1331) |
| F13A | Ac-BSTP8RRRLBRXAKRLQ-NH2 | (SEQ ID NO: 1332) |
| K14A | Ac-BSTP8RRRLBRXFARLQ-NH2 | (SEQ ID NO: 1333) |
| R15A | Ac-BSTP8RRRLBRXFKALQ-NH2 | (SEQ ID NO: 1334) |
| L16A | Ac-BSTP8RRRLBRXFKRAQ-NH2 | (SEQ ID NO: 1335) |
| Q17A | Ac-BSTP8RRRLBRXFKRLA-NH2 | (SEQ ID NO: 1336) |

FIG. 6A

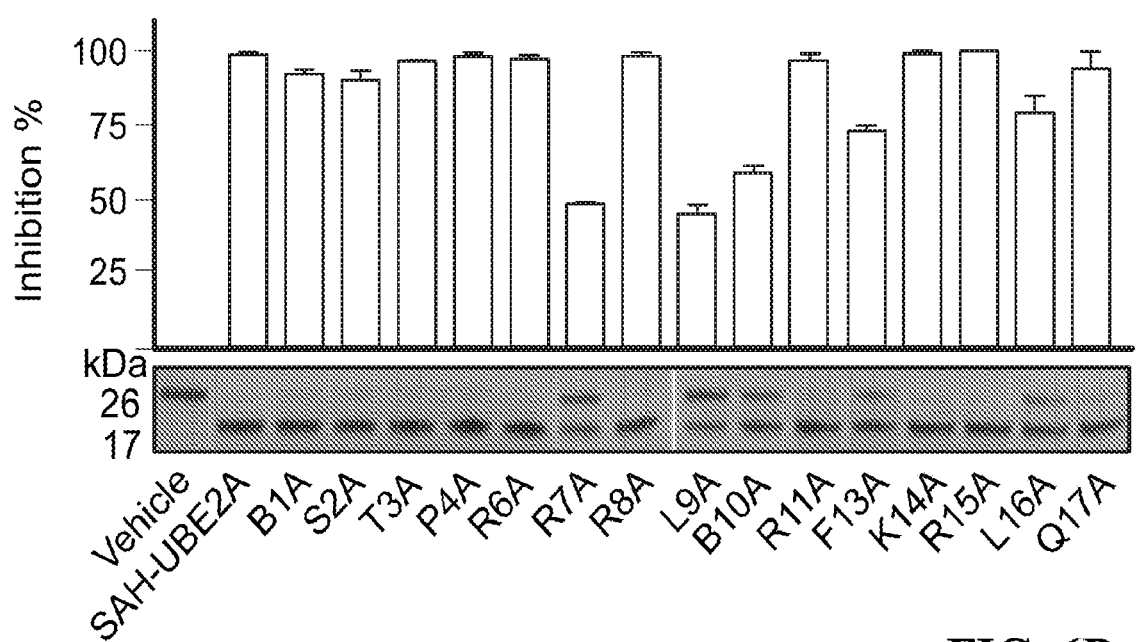

FIG. 6B

| | | |
|---|---|---|
| UBE2A[h1] | ¹MSTPARRRLMRDFKRLQ¹⁷ | (SEQ ID NO: 1321) |
| SAH-UBE2A | Ac-BSTP8RRRLBRXFKRLQ-NH2 | (SEQ ID NO: 132) |
| R6E | Ac-BSTP8ERRLBRXFKRLQ-NH2 | (SEQ ID NO: 1337) |
| R7E | Ac-BSTP8RERLBRXFKRLQ-NH2 | (SEQ ID NO: 1338) |
| R8E | Ac-BSTP8RRELBRXFKRLQ-NH2 | (SEQ ID NO: 1339) |

SELECTIVE TARGETING OF UBIQUITIN- AND UBIQUITIN-LIKE E1-ACTIVATING ENZYMES BY STRUCTURALLY-STABILIZED PEPTIDES

CROSS-REFERENCE TO RELATED APPLICATIONS

This application claims the benefit of priority of U.S. Provisional Application No. 62/835,721, filed Apr. 18, 2019, the contents of which are incorporated by reference herein in their entirety.

STATEMENT REGARDING FEDERALLY SPONSORED RESEARCH

This application is a U.S. National Stage application, and claims priority of International Application No. PCT/US2020/028840, filed Apr. 17, 2020, which claims the benefit of priority of U.S. Provisional Application No. 62/835,721, filed Apr. 18, 2019, the contents of which are incorporated by reference herein in their entirety.

REFERENCE TO SEQUENCE LISTING

The instant application contains a Sequence Listing which has been submitted electronically in ASCII format and is hereby incorporated by reference in its entirety. Said ASCII copy, created on Apr. 17, 2020, is named 00530-0348WO1_SL.txt and is 720,896 bytes in size.

TECHNICAL FIELD

This disclosure relates to structurally-stabilized peptides that target ubiquitin and ubiquitin-like E1-activating enzymes and methods for using such peptides in the treatment of cancer and other diseases of pathologic cell survival.

BACKGROUND

The ubiquitin-proteasome system (UPS) is a highly-regulated enzyme network responsible for intracellular protein degradation. Ubiquitin activating enzymes (E1s) catalyze the charging of ubiquitin conjugating enzymes (E2s) with ubiquitin (Ub). E1s activate Ub by first catalyzing the adenylation of the Ub C-terminus and then forming a high-energy thioester bond between the Ub C-terminus and the E1 catalytic cysteine. E1s then charge E2s by binding to E2 and transferring Ub from the E1 catalytic cysteine to the E2 catalytic cysteine. E2s in turn complex with ubiquitin ligases (E3s) and substrate proteins to transfer the Ub C-terminal carboxyl group covalently onto substrate proteins. The varied architectures of single and multiple Ub linkages to target proteins represent a complex code that regulates protein function and targets proteins for proteasomal degradation. A number of drugs targeting the UPS have been clinically successful in multiple myeloma and mantle cell lymphoma, including immunomodulatory imide drugs (IMiDs) that redirect E3 activity and proteasome inhibitors (e.g., bortezomib for multiple myeloma).

The human genome contains over 600 ubiquitin E3 enzymes, roughly 40 ubiquitin E2 enzymes, and only two ubiquitin E1 enzymes, UBA1 and UBA6. UBA6 is the E1 for only one ubiquitin E2 (USE1), whereas UBA1 is the E1 for all other ubiquitin E2s and correspondingly activates >99% of cellular ubiquitin (Jin et al., Nature, 447: 1135-1138 (2007)). Because the entire UPS system relies almost completely on UBA1, inhibition of UBA1 leads to stabilization of substrates that are normally degraded, endoplasmic reticulum stress, and cell cycle arrest (Hyer et al., Nature Medicine, 24(2):186-193 (2018)). A clinical-grade UBA1 inhibitor, TAK243/MLN7243, has been developed and shown to be highly effective in preclinical mouse models of solid tumors and multiple myeloma (Hyer et al., Nature Medicine, 24(2):186-193 (2018)), and has recently completed a phase 1 clinical trial for advanced solid tumors (NCT02045095). However, a very recent study identifies a point mutation-based resistance mechanism to the drug's mechanism of action (Barghout et al., Leukemia, 2018 Jun. 8. doi: 10.1038/s41375-018-0167-0), underscoring the need for and novelty of potential alternative modes for the targeted inhibition of E1 enzymes.

In parallel to the ubiquitin system, a number of other ubiquitin-like proteins (UBLs) are covalently attached to substrate proteins to signal for a variety of fates. These UBLs have their own activating and conjugating enzymes. UBLs exhibiting the highest homology to the ubiquitin conjugation system include NEDD8 and SUMO (Hochstrasser, Nature, 458: 422-429 (2009)). The E1s for NEDD8 and SUMO are the heterodimeric complexes UBA3-NAE1 and UBA2-SAE1, respectively. Inhibitors of UBA3-NAE1 (MLN4924/pevonedistat) and UBA2-SAE1 (ML-792) with mechanisms analogous to MLN7243 have been developed (Soucy et al., Nature, 458(7239):732-736 (2009); He et al., Nat Chem Biol., 13(11):1164-1171 (2017)). NEDD8 controls the activity of cullin-RING ubiquitin E3 ligases, and correspondingly MLN4924 exerts its therapeutic effects via inhibition of cullin-RING-mediated protein turnover. SUMO has multiple cellular roles including regulation of mitosis, and indeed ML-792 causes mitotic disruption. Both molecules demonstrate potent anti-cancer activity in vitro, and MLN4924 is currently in multiple phase 2 and 3 trials for solid tumors and hematological malignancies (NCT03268954, NCT02610777, NCT03228186, NCT03238248, NCT03330821, NCT03319537).

MLN7243, MLN4924, and ML-792 are adenosyl sulfamates that bind to the ATP binding sites on UBA1, UBA3, and UBA2, respectively. Cancer cell resistance to ATP competitive inhibitors often develops through mutation at or around the target enzyme ATP binding site (Krishnamurty and Maly, ACS Chem Biol., 5(1):121-138 (2010)); indeed, it has been well-established that selective pressure in cancer cells leads to decreased MLN4924 sensitivity over time via positive selection of clonal populations expressing mutant versions of UBA3 including UBA3$^{A171T}$, UBA3$^{A171D}$, UBA3$^{B10N}$, and UBA3$^{Y352H}$ (Milhollen et al., Cancer Cell, 21(3):388-401 (2012); Toth et al., Cell Rep., 1(4):309-316 (2012); Xu et al., PLoS One, 9(4):e93530 (2014)). UBA1$^{A580T}$, UBA1$^{A580S}$, and UBA1$^{Y583C}$ are likewise resistant to MLN7243 (Misra et al., Structure, 25(7): 1120-1129 (2017), Barghout et al., Leukemia, 2018 Jun. 8. doi: 10.1038/s41375-018-0167-0) and UBA2$^{S95N,M97T}$ is resistant to ML-792 (He et al., Nat Chem Biol., 13(11):1164-1171 (2017)). Thus, despite early successes of these inhibitors, the evident threat of resistance via active-site mutation necessitates development of alternate modes of inhibition of these enzymes for the treatment of hematologic malignancies and solid tumors. To date, no other drug lead compound exhibiting an alternate mode of ubiquitin E1 activating enzyme inhibition has been developed.

Accordingly, there is a need for new inhibitors of these ubiquitin and ubiquitin-like activating enzymes.

SUMMARY

E1s activate Ub by first catalyzing the adenylation of the Ub C-terminus and then forming a high-energy thioester bond between the Ub C-terminus and the E1 catalytic cysteine. E1s then charge E2s by binding to E2 and transferring Ub from the E1 catalytic cysteine to the E2 catalytic cysteine. E2s in turn complex with ubiquitin ligases (E3s) and substrate proteins to transfer the Ub C-terminal carboxyl group covalently onto substrate proteins. The interaction between E1 and E2 buries 3000 Å2 of protein surface area, 1000 Å2 of which is buried in the interface between helix A of the E2 (E2 hA) and the E1 ubiquitin fold domain (E1 UFD). The interaction between E1 and E2 hA is important in the formation of the E1-E2 encounter complex. This disclosure provides structurally stabilized (e.g., stapled) alpha-helical peptides mimicking E2 hA (e.g., stapled versions of SEQ ID NOs.: 1-37, 39, 55-63, or 792-806) that can act as direct inhibitors of E1, such as by competitive inhibition of the E1-E2 interaction (see, e.g., E1 and E2s of Tables 1-5). In certain aspects, the structurally stabilized (e.g., stapled) E2 hA peptides bind to the E1 UFD (e.g., aa 950 to 1058 of SEQ ID NO: 845; aa 444 to 552 of SEQ ID NO: 846; aa 445 to 561 of SEQ ID NO:847; aa 950 to 1052 of SEQ ID NO:848; or aa 911 to 1012 of SEQ ID NO: 849). In some cases, the structurally stabilized (e.g., stapled) E2 hA peptides have 1 to 10 (e.g., 1, 2, 3, 4, 5, 6, 7, 8, 9, 10) amino acid substitutions within any one of SEQ ID NOs.: 1-37, 39, 55-63, or 792-806. If methionine is present in the peptide or structurally stabilized peptide, in certain instances, it is substituted with norleucine. In some cases, the structurally stabilized (e.g., stapled) peptides have 1 to 5 deletions at the N or C-terminus. These structurally stabilized variant E2 hA peptides inhibit E1-E2 interaction. In some cases, these peptides inhibit E1-mediated thioester transfer to E2 in a dose-dependent manner. This disclosure also provides warhead-bearing versions of the stabilized (e.g., stapled) E2 hA peptides described herein, which can covalently bind to a cognate E1. This disclosure also features methods for using such stabilized peptides (or warhead-bearing versions thereof) alone or in combination with other therapeutic agents in the treatment of E1-dependent and/or -expressing cancers (e.g., hematologic malignancies, solid tumors, or other specific cancers described herein below) and other diseases of pathologic cell survival (e.g., antibody-mediated transplant rejection, autoimmune disorders, or inflammatory disorders).

The modification(s) to introduce structural stabilization (e.g., internal cross-linking, e.g., stapling) into the E2 hA peptides described herein may be positioned on: (i) the face of the E2 hA that does not engage in direct interaction with the E2 hA's cognate E1 enzyme, (ii) the interface of the polar and nonpolar faces of the E2 hA, and/or (iii) the face of the E2 hA that directly interacts with the E2 hA's cognate E1 enzyme. In certain instances, the structurally stabilized (e.g., internally cross-linked, e.g., stapled) E2 hA peptides described herein may also contain one or more (e.g., 1, 2, 3, 4, 5) additional amino acid substitutions (relative to the wild type E2 hA peptide sequence), e.g., one or more (e.g., 1, 2, 3, 4, 5) conservative and/or non-conservative amino acid substitutions (i.e., one or more amino acid substitutions in addition to the amino acid substitutions made to the E2 hA to impart the structural stabilization). If methionine is present in the peptide or structurally stabilized peptide, in certain instances, it is substituted with norleucine. In certain instances, these additional substitution(s) are of amino acids that directly interact with the E2 hA's cognate E1 enzyme. In certain instances, these additional substitution(s) are of amino acids that do not engage in direct interaction with the E2 hA's cognate E1 enzyme. In certain instances, these additional substitutions are of both amino acids that directly interact with the E2 hA's cognate E1 enzyme and amino acids that do not engage in direct interaction with the E2 hA's cognate E1 enzyme. In certain instances, the structurally stabilized (e.g., internally cross-linked, e.g., stapled) E2 hA peptides described herein may also contain one or more (e.g., 1, 2, 3, 4, 5, 6, 7, 8, 9, 10) deletions from the N- and/or C-terminus of the E2 hA. For example, the structurally stabilized (e.g., internally cross-linked, e.g., stapled) E2 hA peptides may be 5 or more (e.g., 5, 6, 7, 8, 9, 10, 11, 12, 13, 14 15, 16) amino acids in length. In certain instances, the structurally stabilized (e.g., internally cross-linked, e.g., stapled) E2 hA peptides are 5-11 amino acids in length. In certain instances, the structurally stabilized (e.g., internally cross-linked, e.g., stapled) E2 hA peptides are 5-16 amino acids in length. In certain instances, the structurally stabilized (e.g., internally cross-linked, e.g., stapled) E2 hA peptides are 11-16 amino acids in length.

Thus, provided herein is a peptide comprising an amino acid sequence of at least 8 contiguous amino acids of the sequence of SEQ ID NO:132 with 0 to 10 (e.g., 1, 2, 3, 4, 5, 6, 7, 8, 9, 10) amino acid substitutions. In certain embodiments, the substitutions, if present, are not at positions 5 and 12 of SEQ ID NO:132. In certain embodiments, the peptide inhibits human E1-human E2 interaction. In certain embodiments, the peptide inhibits a human E1-mediated thioester transfer to a human E2. In certain embodiments, position 5 is R-octenyl alanine and position 12 is S-pentenyl alanine. Also provide herein is a salt of the peptide. In some instances, the salt is acetate, sulfate, or chloride.

In certain embodiments, the peptide has 1 to 10 (e.g., 1, 2, 3, 4, 5, 6, 7, 8, 9, 10) amino acid substitutions, wherein the substitutions are not at positions 7 and 9, or positions 7 or 9, of SEQ ID NO:132. In certain embodiments, the peptide has 1 to 10 amino acid substitutions and wherein the substitutions are not at one or more (e.g., 1, 2, 3, 4, 5) of positions 7, 9, 10, 13, and 16 of SEQ ID NO:132. In certain embodiments, the peptide has 1 to 10 amino acid substitutions and wherein the substitutions are at one or more of positions 7, 9, 10, 13, and 16 of SEQ ID NO:132, and wherein the substitution is to alanine at one or more of these positions. In certain embodiments, the peptide has 1 to 10 amino acid substitutions, wherein the substitutions are at one or more (e.g., 1, 2, 3, 4, 5, 6, 7, 8, 9, 10, 11, 12) of positions 1, 2, 3, 4, 6, 8, 11, 13, 14, 15, 16, or 17 of SEQ ID NO:132. In some cases, these positions are substituted to alanine. In some cases positions 6 and 8, or positions 6 or 8, of SEQ ID NO:132 are substituted to glutamic acid. In certain embodiments, the peptide has 1 to 10 amino acid substitutions, wherein the substitutions comprise one or more of positions 6 or 8 of SEQ ID NO:132. In some cases, these positions are substituted to glutamic acid. In certain embodiments, the peptide further comprises a reactive group that can form a covalent bond with a cysteine residue within the human E1, optionally wherein the reactive group is a non-natural amino acid bearing an electrophilic group or an electrophilic chemical cap at the N terminus. The reactive group can be at the N—C— or within (i.e., an amino acid between the N and C terminus can be substituted with a non-natural amino acid bearing an electrophilic group or an electrophilic chemical cap at the N terminus) SEQ ID NO:132.

In certain embodiments, the peptide is 8 to 50, 8 to 40, 8 to 30, 8 to 25, 8 to 20, 8 to 17, 10 to 50, 10 to 40, 10 to 30, 10 to 25, 10 to 20, 10 to 17, 15 to 50, 15 to 40, 15 to 30, 15 to 25, 15 to 20, 15 to 17, 17 to 50, 17 to 40, 17 to 30, 17 to 25, 17 to 20, or 8, 9, 10, 11, 12, 13, 14, 15, 16, 17, 18, 19, 20, 21, 22, 23, 24, or 25 amino acids in length. In certain embodiments, the peptide or salt thereof is internally cross-linked. In some cases, the side chains of the non-natural amino acids comprising olefinic side chains are linked.

Also disclosed herein is a peptide or salt thereof, the peptide comprising at least 8 contiguous amino acids of the sequence with the following residues from N terminus to C-terminus:

Xaa1=B, A, wherein B is norleucine, or absent;
Xaa2=S, A, or absent;
Xaa3=T, A, or absent;
Xaa4=P, A, or absent;
Xaa5=a stapling amino acid
Xaa6=R, E, or A;
Xaa7=R or A;
Xaa8=R, E, or A;
Xaa9=L, A, or a reactive group that can form a covalent bond with a cysteine residue within the human E1, optionally wherein the reactive group is a non-natural amino acid bearing an electrophilic group or an electrophilic chemical cap at the N terminus;
Xaa10=B or A, wherein B is norleucine;
Xaa11=R or A;
Xaa12=a stapling amino acid;
Xaa13=F, A, a reactive group that can form a covalent bond with a cysteine residue within the human E1, optionally wherein the reactive group is a non-natural amino acid bearing an electrophilic group or an electrophilic chemical cap at the N terminus, or absent;
Xaa14=K, R, A or absent;
Xaa15=R, A, or absent
Xaa16=L, A, or absent; and
Xaa17=Q, A, or absent,
wherein the peptide inhibits interaction between a human E1 a human E2. In some cases, the peptide inhibits a human E1-mediated thioester transfer to a human E2.

In certain embodiments, the peptide is 8 to 50, 8 to 40, 8 to 30, 8 to 25, 8 to 20, 8 to 17, 10 to 50, 10 to 40, 10 to 30, 10 to 25, 10 to 20, 10 to 17, 15 to 50, 15 to 40, 15 to 30, 15 to 25, 15 to 20, 15 to 17, 17 to 50, 17 to 40, 17 to 30, 17 to 25, 17 to 20, or 8, 9, 10, 11, 12, 13, 14, 15, 16, 17, 18, 19, 20, 21, 22, 23, 24, or 25 amino acids in length. In certain embodiments, the peptide or salt thereof is internally cross-linked. In some cases, the side chains of the non-natural amino acids comprising olefinic side chains are linked.

In another aspect, the disclosure features a peptide comprising the amino acid sequence of any one of SEQ ID NOs.: 680, 727, 752, 841, 842, or 844, with 1 to 10 (e.g., 1, 2, 3, 4, 5, 6, 7, 8, 9, or 10) amino acid substitutions where the stapled positions (i.e., the positions that have the non-natural amino acid with olefinic side chains) in these peptides are not substituted. In some cases, the residues that are predicted to interact directly with the E1 are either not substituted, or substituted with alanine or a conservative amino acid. All other residues can be substituted. If methionine is present in the peptide or structurally stabilized peptide, in certain instances, it is substituted with norleucine. These peptides inhibit the E1-E2 interaction. In some instances, they inhibit E1-mediated thioester transfer to E2 in a dose-dependent manner.

Also provided herein is a method of making a structurally stabilized peptide. In some instances, the method includes providing a peptide as described herein and cross-linking the peptide. In some instances, crosslinking is by a RCM reaction. In some instances, the method further includes formulating the cross-linked peptide as a pharmaceutical composition.

Also provided herein is a pharmaceutical composition comprising any peptide or salt thereof disclosed herein and a pharmaceutically acceptable carrier.

Also provided herein is a method of treating an E1-expressing or E1-dependent disease in a human subject in need thereof, the method comprising administering to the human subject a therapeutically effective amount of any peptide, salt thereof, or pharmaceutical composition disclosed herein. In some instances, the E1-expressing or E1-dependent disease is cancer. In some instances, the E1-expressing or E1-dependent disease is a hematological malignancy, a solid tumor, an antibody-mediated transplant rejection, an autoimmune disorder, or an inflammatory disorder. In some instances, the human subject has not been responding, or has developed resistance, to a therapy to treat the E1-expressing or E1-dependent disease.

In another aspect, provided herein is a peptide comprising: a modified amino acid sequence of the sequence set forth in amino acids A1 to A11 of any one of SEQ ID NOs:1-33, wherein one or more of the A1 to A11 amino acids are substituted by another amino acid; wherein the modified amino acid sequence comprises at least one peptide structure stabilizing modification; and wherein the peptide binds to and inhibits Ubiquitin Activating Enzyme 1 (UBA1).

In certain embodiments, the peptide structure stabilizing modification comprises substitution of at least two amino acids of the sequence set forth in amino acids $A_1$ to $A_{11}$ of any one of SEQ ID NOs:1-33 with non-natural amino acids, wherein the non-natural amino acids comprise olefinic side chains.

In certain embodiments, the peptide structure stabilizing modification is a hydrocarbon staple/stitch, a lactam staple/stitch; a UV-cycloaddition staple/stitch; an oxime staple/stitch; a thioether staple/stitch; a double-click staple/stitch; a bis-lactam staple/stitch; a bis-arylation staple/stitch; or a combination of any two or more thereof. In certain embodiments, the peptide structure stabilizing modification is a stitch.

In certain embodiments, the peptide structure stabilizing modification is a staple. In certain embodiments, the staple is at one or more of two positions in the amino acid sequence, wherein the two positions are i and i+3; i and i+4; i and i+6; or i and i+7. In certain embodiments, the staple is at one or more of two positions in the amino acid sequence, wherein the two positions are selected from the group consisting of $A_2$ and $A_9$, $A_5$ and $A_9$, $A_8$ and $A_{12}$, $A_9$ and $A_{13}$, $A_1$ and $A_8$, $A_4$ and $A_{11}$, and $A_5$ and $A_{12}$. In certain embodiments, the staple is at two positions, wherein the two positions are A2 and A9. In certain embodiments, the staple comprises an amino acid substitution at each of the two positions, wherein each of the amino acid substitutions is a substitution with a non-natural amino, wherein the non-natural amino acid comprises olefinic side chain(s).

In certain embodiments in which the peptide of the first aspect comprises non-natural amino acids comprising olefinic side chains, the non-natural amino acids comprising olefinic side chains are selected from the group consisting of: S-pentenyl alanine, R-octenyl alanine; R-propenylalanine, S-pentenylalanine; R-pentenylalanine, S-pentenylalanine; Bis-pentenylglycine, S-pentenylalanine, R-octenylalanine; and Bis-pentenylglycine, S-octenylalanine, and R-octenylalanine.

In certain embodiments, (a) the modified amino acid sequence comprises a modified amino acid sequence of the sequence set forth in amino acids $A_1$ to $A_{11}$ of SEQ ID NO:4, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:4; (b) the modified amino acid sequence comprises a modified amino acid sequence of the sequence set forth in amino acids $A_1$ to $A_{11}$ of SEQ ID NO:6, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:6; (c) the modified amino acid sequence comprises a modified amino acid sequence of the sequence set forth in amino acids $A_1$ to $A_{11}$ of SEQ ID NO:1, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:1; (d) the modified amino acid sequence comprises a modified amino acid sequence of the sequence set forth in amino acids $A_1$ to $A_{11}$ of SEQ ID NO:2, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:2; (e) the modified amino acid sequence comprises a modified amino acid sequence of the sequence set forth in amino acids $A_1$ to $A_{11}$ of SEQ ID NO:3, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:3; (0 the modified amino acid sequence comprises a modified amino acid sequence of the sequence set forth in amino acids $A_1$ to $A_{11}$ of SEQ ID NO:5, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:5; (g) the modified amino acid sequence comprises a modified amino acid sequence of the sequence set forth in amino acids $A_1$ to $A_{11}$ of SEQ ID NO:7, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:7; (h) the modified amino acid sequence comprises a modified amino acid sequence of the sequence set forth in amino acids $A_1$ to $A_{11}$ of SEQ ID NO:8, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:8; (i) the modified amino acid sequence comprises a modified amino acid sequence of the sequence set forth in amino acids $A_1$ to $A_{11}$ of SEQ ID NO:9, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:9; (j) the modified amino acid sequence comprises a modified amino acid sequence of the sequence set forth in amino acids $A_1$ to $A_{11}$ of SEQ ID NO:10, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:10; (k) the modified amino acid sequence comprises a modified amino acid sequence of the sequence set forth in amino acids $A_1$ to $A_{11}$ of SEQ ID NO:11, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:11; (l) the modified amino acid sequence comprises a modified amino acid sequence of the sequence set forth in amino acids $A_1$ to $A_{11}$ of SEQ ID NO:12, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:12; (m) the modified amino acid sequence comprises a modified amino acid sequence of the sequence set forth in amino acids $A_1$ to $A_{11}$ of SEQ ID NO:13, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:13; (n) the modified amino acid sequence comprises a modified amino acid sequence of the sequence set forth in amino acids $A_1$ to $A_{11}$ of SEQ ID NO:14, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:14; (o) the modified amino acid sequence comprises a modified amino acid sequence of the sequence set forth in amino acids $A_1$ to $A_{11}$ of SEQ ID NO:15, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:15; (p) the modified amino acid sequence comprises a modified amino acid sequence of the sequence set forth in amino acids $A_1$ to $A_{11}$ of SEQ ID NO:16, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:16; (q) the modified amino acid sequence comprises a modified amino acid sequence of the sequence set forth in amino acids $A_1$ to $A_{11}$ of SEQ ID NO:17, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:17; (r) the modified amino acid sequence comprises a modified amino acid sequence of the sequence set forth in amino acids $A_1$ to $A_{11}$ of SEQ ID NO:18, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:18; (s) the modified amino acid sequence comprises a modified amino acid sequence of the sequence set forth in amino acids $A_1$ to $A_{11}$ of SEQ ID NO:19, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:19; (t) the modified amino acid sequence comprises a modified amino acid sequence of the sequence set forth in amino acids $A_1$ to $A_{11}$ of SEQ ID NO:20, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:20; (u) the modified amino acid sequence comprises a modified amino acid sequence of the sequence set forth in amino acids $A_1$ to $A_{11}$ of SEQ ID NO:21, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:21; (v) the modified amino acid sequence comprises a modified amino acid sequence of the sequence set forth in amino acids $A_1$ to $A_{11}$ of SEQ ID NO:22, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:22; (w) the modified amino acid sequence comprises a modified amino acid sequence of the sequence set forth in amino acids $A_1$ to $A_{11}$ of SEQ ID NO:23, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:23; (x) the modified amino acid sequence comprises a modified amino acid sequence of the sequence set forth in amino acids $A_1$ to $A_{11}$ of SEQ ID NO:24, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:24; (y) the modified amino acid sequence comprises a modified amino acid sequence of the sequence set forth in amino acids $A_1$ to $A_{11}$ of SEQ ID NO:25, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:25; (z) the modified amino acid sequence comprises a modified amino acid sequence of the sequence set forth in amino acids $A_1$ to $A_{11}$ of SEQ ID NO:26, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:26; (aa) the modified amino acid sequence comprises a modified amino acid sequence of the sequence set forth in amino acids $A_1$ to $A_{11}$ of SEQ ID NO:27, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:27; (bb) the modified amino acid sequence comprises a modified amino acid sequence of the sequence set forth in amino acids $A_1$ to $A_{11}$ of SEQ ID NO:28, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:28; (cc) the modified amino acid sequence comprises a modified amino acid sequence of the sequence set forth in amino acids $A_1$ to $A_{11}$ of SEQ ID NO:29, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:29; (dd) the modified amino acid sequence comprises a modified amino acid sequence of the sequence set forth in amino acids $A_1$ to $A_{11}$ of SEQ ID NO:30, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:30; (ee) the modified amino acid sequence comprises a modified amino acid sequence of the sequence set forth in amino acids $A_1$ to $A_{11}$ of SEQ ID NO:31, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:31; (ff) the modified amino acid sequence comprises a modified amino acid sequence of the sequence set forth in amino acids $A_1$ to $A_{11}$ of SEQ ID NO:32, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:32; or (gg) the modified amino acid sequence comprises a modified amino acid sequence of the sequence set forth in amino acids $A_1$ to $A_{11}$ of SEQ ID NO:33, and wherein the modified amino acid sequence comprises zero, one, two, three, four, or five amino acid substitutions at amino acid positions selected from the group consisting of $A_1$, $A_2$, $A_3$, $A_5$, $A_8$, $A_9$, and $A_{11}$ of SEQ ID NO:33.

In certain embodiments, (a) the modified amino acid sequence comprises a modified amino acid sequence of the sequence set forth in amino acids $A_1$ to $A_{11}$ of SEQ ID NO:4, and wherein the modified amino acid sequence comprises zero, one, or two conservative amino acid substitutions at amino acid positions selected from the group consisting of $A_4$, $A_6$, $A_7$, and $A_{10}$ of SEQ ID NO:4; (b) the modified amino acid sequence comprises a modified amino acid sequence of the sequence set forth in amino acids $A_1$ to $A_{11}$ of SEQ ID NO:6, and wherein the modified amino acid sequence comprises zero, one, or two conservative amino acid substitutions at amino acid positions selected from the group consisting of $A_4$, $A_6$, $A_7$, and $A_{10}$ of SEQ ID NO:6; (c) the modified amino acid sequence comprises a modified amino acid sequence of the sequence set forth in amino acids $A_1$ to $A_{11}$ of SEQ ID NO:1, and wherein the modified amino acid sequence comprises zero, one, or two conservative amino acid substitutions at amino acid positions selected from the group consisting of $A_4$, $A_6$, $A_7$, and $A_{10}$ of SEQ ID NO:1; (d) the modified amino acid sequence comprises a modified amino acid sequence of the sequence set forth in amino acids $A_1$ to $A_{11}$ of SEQ ID NO:2, and wherein the modified amino acid sequence comprises zero, one, or two conservative amino acid substitutions at amino acid positions selected from the group consisting of $A_4$, $A_6$, $A_7$, and $A_{10}$ of SEQ ID NO:2; (e) the modified amino acid sequence comprises a modified amino acid sequence of the sequence set forth in amino acids $A_1$ to $A_{11}$ of SEQ ID NO:3, and wherein the modified amino acid sequence comprises zero, one, or two conservative amino acid substitutions at amino acid positions selected from the group consisting of $A_4$, $A_6$, $A_7$, and $A_{10}$ of SEQ ID NO:3; (f) the modified amino acid sequence comprises a modified amino acid sequence of the sequence set forth in amino acids $A_1$ to $A_{11}$ of SEQ ID NO:5, and wherein the modified amino acid sequence comprises zero, one, or two conservative amino acid substitutions at amino acid positions selected from the group consisting of $A_4$, $A_6$, $A_7$, and $A_{10}$ of SEQ ID NO:5; (g) the modified amino acid sequence comprises a modified amino acid sequence of the sequence set forth in amino acids $A_1$ to $A_{11}$ of SEQ ID NO:7, and wherein the modified amino acid sequence comprises zero, one, or two conservative amino acid substitutions at amino acid positions selected from the group consisting of $A_4$, $A_6$, $A_7$, and $A_{10}$ of SEQ ID NO:7; (h) the modified amino acid sequence comprises a modified amino acid sequence of the sequence set forth in amino acids $A_1$ to $A_{11}$ of SEQ ID NO:8, and wherein the modified amino acid sequence comprises zero, one, or two conservative amino acid substitutions at amino acid positions selected from the group consisting of $A_4$, $A_6$, $A_7$, and $A_{10}$ of SEQ ID NO:8; (i) the modified amino acid sequence comprises a modified amino acid sequence of the sequence set forth in amino acids $A_1$ to $A_{11}$ of SEQ ID NO:9, and wherein the modified amino acid sequence comprises zero, one, or two conservative amino acid substitutions at amino acid positions selected from the group consisting of $A_4$, $A_6$, $A_7$, and $A_{10}$ of SEQ ID NO:9; (j) the modified amino acid sequence comprises a modified amino acid sequence of the sequence set forth in amino acids $A_1$ to $A_{11}$ of SEQ ID NO:10, and wherein the modified amino acid sequence comprises zero, one, or two conservative amino acid substitutions at amino acid positions selected from the group consisting of $A_4$, $A_6$, $A_7$, and $A_{10}$ of SEQ ID NO:10; (k) the modified amino acid sequence comprises a modified amino acid sequence of the sequence set forth in amino acids $A_1$ to $A_{11}$ of SEQ ID NO:11, and wherein the modified amino acid sequence comprises zero, one, or two conservative amino acid substitutions at amino acid positions selected from the group consisting of $A_4$, $A_6$, $A_7$, and $A_{10}$ of SEQ ID NO:11; (l) the modified amino acid sequence comprises a modified amino acid sequence of the sequence set forth in amino acids $A_1$ to $A_{11}$ of SEQ ID NO:12, and wherein the modified amino acid sequence comprises zero, one, or two conservative amino acid substitutions at amino acid positions selected from the group consisting of $A_4$, $A_6$, $A_7$, and $A_{10}$ of SEQ ID NO:12; (m) the modified amino acid sequence comprises a modified amino acid sequence of the sequence set forth in amino acids $A_1$ to $A_{11}$ of SEQ ID NO:13, and wherein the modified amino acid sequence comprises zero, one, or two conservative amino acid substitutions at amino acid positions selected from the group consisting of $A_4$, $A_6$, $A_7$, and $A_{10}$ of SEQ ID NO:13; (n) the modified amino acid sequence comprises a modified amino acid sequence of the sequence set forth in amino acids $A_1$ to $A_{11}$ of SEQ ID NO:14, and wherein the modified amino acid sequence comprises zero, one, or two conservative amino acid substitutions at amino acid positions selected from the group consisting of $A_4$, $A_6$, $A_7$, and $A_{10}$ of SEQ ID NO:14; (o) the modified amino acid sequence comprises a modified amino acid sequence of the sequence set forth in amino acids $A_1$ to $A_{11}$ of SEQ ID NO:15, and wherein the modified amino acid sequence comprises zero, one, or two conservative amino acid substitutions at amino acid positions selected from the group consisting of $A_4$, $A_6$, $A_7$, and $A_{10}$ of SEQ ID NO:15; (p) the modified amino acid sequence comprises a modified amino acid sequence of the sequence set forth in amino acids $A_1$ to $A_{11}$ of SEQ ID NO:16, and wherein the modified amino acid sequence comprises zero, one, or two conservative amino acid substitutions at amino acid positions selected from the group consisting of $A_4$, $A_6$, $A_7$, and $A_{10}$ of SEQ ID NO:16; (q) the modified amino acid sequence comprises a modified amino acid sequence of the sequence set forth in amino acids $A_1$ to $A_{11}$ of SEQ ID NO:17, and wherein the modified amino acid sequence comprises zero, one, or two conservative amino acid substitutions at amino acid positions selected from the group consisting of $A_4$, $A_6$, $A_7$, and $A_{10}$ of SEQ ID NO:17; (r) the modified amino acid sequence comprises a modified amino acid sequence of the sequence set forth in amino acids $A_1$ to $A_{11}$ of SEQ ID NO:18, and wherein the modified amino acid sequence comprises zero, one, or two conservative amino acid substitutions at amino acid positions selected from the group consisting of $A_4$, $A_6$, $A_7$, and $A_{10}$ of SEQ ID NO:18; (s) the modified amino acid sequence comprises a modified amino acid sequence of the sequence set forth in amino acids $A_1$ to $A_{11}$ of SEQ ID NO:19, and wherein the modified amino acid sequence comprises zero, one, or two conservative amino acid substitutions at amino acid positions selected from the group consisting of $A_4$, $A_6$, $A_7$, and $A_{10}$ of SEQ ID NO:19; (t) the modified amino acid sequence comprises a modified amino acid sequence of the sequence set forth in amino acids $A_1$ to $A_{11}$ of SEQ ID NO:20, and wherein the modified amino acid sequence comprises zero, one, or two conservative amino acid substitutions at amino acid positions selected from the group consisting of $A_4$, $A_6$, $A_7$, and $A_{10}$ of SEQ ID NO:20; (u) the modified amino acid sequence comprises a modified amino acid sequence of the sequence set forth in amino acids $A_1$ to $A_{11}$ of SEQ ID NO:21, and wherein the modified amino acid sequence comprises zero, one, or two conservative amino acid substitutions at amino acid positions selected from the group consisting of $A_4$, $A_6$, $A_7$, and $A_{10}$ of SEQ ID NO:21; (v) the modified amino acid sequence comprises a modified amino acid sequence of the sequence set forth in amino acids $A_1$ to $A_{11}$ of SEQ ID NO:22, and wherein the modified amino acid sequence comprises zero, one, or two conservative amino acid substitutions at amino acid positions selected from the group consisting of $A_4$, $A_6$, $A_7$, and $A_{10}$ of SEQ ID NO:22; (w) the modified amino acid sequence comprises a modified amino acid sequence of the sequence set forth in amino acids $A_1$ to $A_{11}$ of SEQ ID NO:23, and wherein the modified amino acid sequence comprises zero, one, or two conservative amino acid substitutions at amino acid positions selected from the group consisting of $A_4$, $A_6$, $A_7$, and $A_{10}$ of SEQ ID NO:23; (x) the modified amino acid sequence comprises a modified amino acid sequence of the sequence set forth in amino acids $A_1$ to $A_{11}$ of SEQ ID NO:24, and wherein the modified amino acid sequence comprises zero, one, or two conservative amino acid substitutions at amino acid positions selected from the group consisting of $A_4$, $A_6$, $A_7$, and $A_{10}$ of SEQ ID NO:24; (y) the modified amino acid sequence comprises a modified amino acid sequence of the sequence set forth in amino acids $A_1$ to $A_{11}$ of SEQ ID NO:25, and wherein the modified amino acid sequence comprises zero, one, or two conservative amino acid substitutions at amino acid positions selected from the group consisting of $A_4$, $A_6$, $A_7$, and $A_{10}$ of SEQ ID NO:25; (z) the modified amino acid sequence comprises a modified amino acid sequence of the sequence set forth in amino acids $A_1$ to $A_{11}$ of SEQ ID NO:26, and wherein the modified amino acid sequence comprises zero, one, or two conservative amino acid substitutions at amino acid positions selected from the group consisting of $A_4$, $A_6$, $A_7$, and $A_{10}$ of SEQ ID NO:26; (aa) the modified amino acid sequence comprises a modified amino acid sequence of the sequence set forth in amino acids $A_1$ to $A_{11}$ of SEQ ID NO:27, and wherein the modified amino acid sequence comprises zero, one, or two conservative amino acid substitutions at amino acid positions selected from the group consisting of $A_4$, $A_6$, $A_7$, and $A_{10}$ of SEQ ID NO:27; (bb) the modified amino acid sequence comprises a modified amino acid sequence of the sequence set forth in amino acids $A_1$ to $A_{11}$ of SEQ ID NO:28, and wherein the modified amino acid sequence comprises zero, one, or two conservative amino acid substitutions at amino acid positions selected from the group consisting of $A_4$, $A_6$, $A_7$, and $A_{10}$ of SEQ ID NO:28; (cc) the modified amino acid sequence comprises a modified amino acid sequence of the sequence set forth in amino acids $A_1$ to $A_{11}$ of SEQ ID NO:29, and wherein the modified amino acid sequence comprises zero, one, or two conservative amino acid substitutions at amino acid positions selected from the group consisting of $A_4$, $A_6$, $A_7$, and $A_{10}$ of SEQ ID NO:29; (dd) the modified amino acid sequence comprises a modified amino acid sequence of the sequence set forth in amino acids $A_1$ to $A_{11}$ of SEQ ID NO:30, and wherein the modified amino acid sequence comprises zero, one, or two conservative amino acid substitutions at amino acid positions selected from the group consisting of $A_4$, $A_6$, $A_7$, and $A_{10}$ of SEQ ID NO:30; (ee) the modified amino acid sequence comprises a modified amino acid sequence of the sequence set forth in amino acids $A_1$ to $A_{11}$ of SEQ ID NO:31, and wherein the modified amino acid sequence comprises zero, one, or two conservative amino acid substitutions at amino acid positions selected from the group consisting of $A_4$, $A_6$, $A_7$, and $A_{10}$ of SEQ ID NO:31; (ff) the modified amino acid sequence comprises a modified amino acid sequence of the sequence set forth in amino acids $A_1$ to $A_{11}$ of SEQ ID NO:32, and wherein the modified amino acid sequence comprises zero, one, or two conservative amino acid substitutions at amino acid positions selected from the group consisting of $A_4$, $A_6$, $A_7$, and $A_{10}$ of SEQ ID NO:32; or (gg) the modified amino acid sequence comprises a modified amino acid sequence of the sequence set forth in amino acids $A_1$ to $A_{11}$ of SEQ ID NO:33, and wherein the modified amino acid sequence comprises zero, one, or two conservative amino acid substitutions at amino acid positions selected from the group consisting of $A_4$, $A_6$, $A_7$, and $A_{10}$ of SEQ ID NO:33.

In certain embodiments, the one or more of amino acids $A_1$-$A_{11}$ that are substituted by another amino acid are on the E1 non-interacting face of amino acids $A_1$-$A_{11}$ of SEQ ID NO:1-33. In certain embodiments, the non-interacting face of SEQ ID NO:1-33 comprises amino acids $A_1$, $A_2$, $A_5$, $A_8$, $A_9$, and $A_{12}$.

In certain embodiments, 0 to 6 amino acids on the non-interacting face of amino acids $A_1$-$A_{11}$ of any one of SEQ ID NO:1-33 are substituted with an amino acid selected from the group consisting of alanine, D-alanine, α-aminoisobutyric acid, N-methyl glycine, serine, a substituted alanine, and a glycine derivative.

In certain embodiments, one or more of amino acids $A_4$, $A_6$, $A_7$, and $A_{10}$ are substituted with an alpha-methylated or alpha-ethylated natural amino acids. In certain embodiments, one or more of amino acids $A_4$, $A_6$, $A_7$, and $A_{10}$ are substituted with an amino acid selected from the group consisting of L-alanine, D-alanine, α-aminoisobutyric acid, N-methyl glycine, serine, a substituted alanine, and a glycine derivative.

In certain embodiments, one or more of amino acids $A_1$, $A_2$, $A_3$, $A_5$, $A_8$, $A_9$, and $A_{11}$ are substituted with an alpha-methylated or alpha-ethylated natural amino acids. In certain embodiments, one or more of amino acids $A_1$, $A_2$, $A_3$, $A_5$, $A_8$, $A_9$, and $A_{11}$ are substituted with an amino acid selected from the group consisting of L-alanine, D-alanine, α-aminoisobutyric acid, N-methyl glycine, serine, a substituted alanine, and a glycine derivative.

In certain embodiments, the modified amino acid sequence comprises a modified amino acid sequence of the sequence set forth in amino acids $A_1$ to $A_{11}$ of SEQ ID NO:4.

In certain embodiments, the modified amino acid sequence comprises a modified amino acid sequence of the sequence set forth in amino acids $A_1$ to $A_{11}$ of SEQ ID NO:6.

In certain embodiments, the modified amino acid sequence comprises a modified amino acid sequence of the sequence set forth in any one of SEQ ID NOs:1-33. In certain embodiments, the one or more amino acids of SEQ ID NO:1-33 are substituted by an amino acid or amino acids selected from the group consisting of L-alanine, D-alanine, α-aminoisobutyric acid, N-methyl glycine, serine, a substituted alanine, and a glycine derivative. In certain embodiments, 0 to 5 amino acids in SEQ ID NO:1-33 are removed from the C-terminal or are removed and replaced with 1 to 6 amino acids from the group consisting of alanine, D-alanine, α-aminoisobutyric acid, N-methyl glycine, serine, a substituted alanine, and a glycine derivative. In certain embodiments, the one or more amino acids of SEQ ID NO:1-33 that are substituted by another amino acid are on the E1 non-interacting face of amino acids of SEQ ID NO:1-33. In certain embodiments, the modified amino acid sequence comprises a modified amino acid sequence of the sequence set forth in SEQ ID NO:4. In certain embodiments, the modified amino acid sequence comprises a modified amino acid sequence of the sequence set forth in SEQ ID NO:6.

In certain embodiments, (i) overall hydrophobicity of the peptide is reduced relative to a peptide of SEQ ID NO:1-33; (ii) overall positive charge of the peptide is reduced relative to a peptide of SEQ ID NO:1-33; or (iii) a combination of (i) and (ii).

In certain embodiments, the peptide comprises the sequence set forth in SEQ ID NO:132. In certain embodiments, the peptide comprises the sequence set forth in SEQ ID NO:133. In certain embodiments, the peptide comprises the sequence set forth in SEQ ID NO:107. In certain embodiments, the peptide comprises the sequence set forth in SEQ ID NO:50.

In yet another aspect, provided herein is a peptide comprising: a modified amino acid sequence of the sequence set forth in SEQ ID NO:35 or 36, wherein one or more amino acids of SEQ ID NO:35 or 36 are substituted by another amino acid; wherein the modified amino acid sequence comprises at least one peptide structure stabilizing modification; and wherein the peptide binds to and inhibits Ubiquitin Activating Enzyme 3 (UBA3).

In certain embodiments, the peptide structure stabilizing modification comprises substitution of at least two amino acids of the sequence of SEQ ID NO:35 or 36 with non-natural amino acids, wherein the non-natural amino acids comprise olefinic side chains. In certain embodiments, the peptide structure stabilizing modification is a hydrocarbon staple/stitch, a lactam staple/stitch; a UV-cycloaddition staple/stitch; an oxime staple/stitch; a thioether staple/stitch; a double-click staple/stitch; a bis-lactam staple/stitch; a bis-arylation staple/stitch; or a combination of any two or more thereof. In certain embodiments, the peptide structure stabilizing modification is a stich.

In certain embodiments, the peptide structure stabilizing modification is a staple. In certain embodiments, the staple is at one or more of two positions in the amino acid sequence, wherein the two positions are i and i+3; i and i+4; or i and i+7. In certain embodiments, the staple comprises an amino acid substitution at each of the two positions, wherein each of the amino acid substitutions is a substitution with a non-natural amino, wherein the non-natural amino acid comprises olefinic side chain.

In certain embodiments in which the peptide comprises non-natural amino acids comprising olefinic side chains, the non-natural amino acids comprising olefinic side chains are selected from the group consisting of: S-pentenyl alanine, R-octenyl alanine; R-propenylalanine, S-pentenylalanine; R-pentenylalanine, S-pentenylalanine; Bis-pentenylglycine, S-pentenylalanine, R-octenylalanine; and Bis-pentenylglycine, S-octenylalanine, and R-octenylalanine.

In certain embodiments, (a) the modified amino acid sequence comprises a modified amino acid sequence of SEQ ID NO:35, and wherein the modified amino acid sequence comprises zero, one, two, three, four, or five amino acid substitutions at amino acid positions selected from the group consisting of Arg-1, Arg-2, Ser-4, Val-5, Arg-6, Asp-7, Leu-9, Leu-10, Glu-13, Ala-15, and Glu-16 of SEQ ID NO:35; or (b) the modified amino acid sequence comprises a modified amino acid sequence of SEQ ID NO:36, and wherein the modified amino acid sequence comprises zero, one, two, three, four, or five amino acid substitutions at amino acid positions selected from the group consisting of Lys-1, Ser-4, Ala-5, Ala-6, Arg-9, Ile-10, and Asp-13$_4$ of SEQ ID NO:36.

In certain embodiments, (a) the modified amino acid sequence comprises a modified amino acid sequence of SEQ ID NO:35, and wherein the modified amino acid sequence comprises zero, one, or two conservative amino acid substitutions at amino acid positions selected from the group consisting of Val-3, Lys-8, Val-11, Lys-12, and Val-14 of SEQ ID NO:35; or (b) the modified amino acid sequence comprises a modified amino acid sequence of SEQ ID NO:36, and wherein the modified amino acid sequence comprises zero, one, or two conservative amino acid positions selected from the group consisting Lys-2, Ala-3, Gln-7, Leu-8, Gln-11, Lys-12, Ile-14, Asn-15, and Glu-16 of SEQ ID NO:36.

In certain embodiments, the one or more amino acids that are substituted by another amino acid are on the E1 non-interacting face of SEQ ID NO:35 or 36. In certain embodiments, the non-interacting face of SEQ ID NO:35 comprise amino acids Arg-1, Arg-2, Ser-4, Val-5, Arg-6, Asp-7, Leu-9, Leu-10, Glu-13, Ala-15, and Glu-16 of SEQ ID NO:25, and the non-interacting face of SEQ ID NO:36 comprises amino acids Lys-1, Ser-4, Ala-5, Ala-6, Arg-9, Ile-10, and Asp-13 of SEQ ID NO:36.

In certain embodiments, 0 to 6 amino acids on the non-interacting face of SEQ ID NO:35 or 36 are substituted with an amino acid selected from the group consisting of alanine, D-alanine, α-aminoisobutyric acid, N-methyl glycine, serine, a substituted alanine, and a glycine derivative.

In certain embodiments, one or more of amino acids $B_7$, $B_8$, $B_{11}$, $B_{12}$, $B_{15}$, and $B_{16}$ are substituted with an alpha-methylated or alpha-ethylated natural amino acids. In certain embodiments, one or more of amino acids $B_7$, $B_8$, $B_{11}$, $B_{12}$, $B_{15}$, and $B_{16}$ are substituted with an amino acid selected from the group consisting of L-alanine, D-alanine, α-aminoisobutyric acid, N-methyl glycine, serine, a substituted alanine, and a glycine derivative.

In certain embodiments, one or more of amino acids $B_1$, $B_2$, $B_3$, $B_4$, $B_5$, $B_6$, $B_9$, $B_{10}$, $B_{13}$, and $B_{14}$ are substituted with an alpha-methylated or alpha-ethylated natural amino acids. In certain embodiments, one or more of amino acids $B_1$, $B_2$, $B_3$, $B_4$, $B_5$, $B_6$, $B_9$, $B_{10}$, $B_{13}$, and $B_{14}$ are substituted with an amino acid selected from the group consisting of L-alanine, D-alanine, α-aminoisobutyric acid, N-methyl glycine, serine, a substituted alanine, and a glycine derivative.

In certain embodiments, 0 to 5 amino acids in SEQ ID NO:35 or 36 are removed from the C-terminal or are removed and replaced with 1 to 6 amino acids from the group consisting of alanine, D-alanine, α-aminoisobutyric acid, N-methyl glycine, serine, a substituted alanine, and a glycine derivative.

In certain embodiments, (i) overall hydrophobicity of the peptide is reduced relative to a peptide of SEQ ID NO:35 or 36; (ii) overall positive charge of the peptide is reduced relative to a peptide of SEQ ID NO:35 or 36; or (iii) a combination of (i) and (ii).

In a third aspect, provided herein is a peptide comprising: a modified amino acid sequence of the sequence set forth in SEQ ID NO:37, wherein one or more amino acids of SEQ ID NO:37 are substituted by another amino acid; wherein the modified amino acid sequence comprises at least one peptide structure stabilizing modification; and wherein the peptide binds to and inhibits Ubiquitin Activating Enzyme 2 (UBA2).

In certain embodiments, the peptide structure stabilizing modification comprises substitution of at least two amino acids of the sequence of SEQ ID NO:35 or 36 with non-natural amino acids, wherein the non-natural amino acids comprise olefinic side chains. In certain embodiments, the peptide structure stabilizing modification is a hydrocarbon staple/stitch, a lactam staple/stitch; a UV-cycloaddition staple/stitch; an oxime staple/stitch; a thioether staple/stitch; a double-click staple/stitch; a bis-lactam staple/stitch; a bis-arylation staple/stitch; or a combination of any two or more thereof. In certain embodiments, the peptide structure stabilizing modification is a stich.

In certain embodiments, the peptide structure stabilizing modification is a staple. In certain embodiments, the staple is at one or more of two positions in the amino acid sequence, wherein the two positions are i and i+3; i and i+4; or i and i+7. In certain embodiments, the staple comprises an amino acid substitution at each of the two positions, wherein each of the amino acid substitutions is a substitution with a non-natural amino, wherein the non-natural amino acid comprises olefinic side chain.

In certain embodiments in which the peptide comprises non-natural amino acids comprising olefinic side chains, the non-natural amino acids comprising olefinic side chains are selected from the group consisting of: S-pentenyl alanine, R-octenyl alanine; R-propenylalanine, S-pentenylalanine; R-pentenylalanine, S-pentenylalanine; Bis-pentenylglycine, S-pentenylalanine, R-octenylalanine; and Bis-pentenylglycine, S-octenylalanine, and R-octenylalanine.

In certain embodiments, the modified amino acid sequence comprises zero, one, two, three, four, or five amino acid substitutions at amino acid positions selected from the group consisting of Ala-1, Arg-4, Leu-5, Glu-8, Ala-11, Trp-12, and Asp-15 of SEQ ID NO:37.

In certain embodiments, the modified amino acid sequence comprises zero, one, or two conservative amino acid substitutions at amino acid positions selected from the group consisting of Leu-2, Ser-3, Ala-6, Gln-7, Arg-9, Lys-10, Arg-13, and Lys-14 of SEQ ID NO:37.

In certain embodiments, the one or more amino acids that are substituted by another amino acid are on the E1 non-interacting face of SEQ ID NO:37. In certain embodiments, the non-interacting face of SEQ ID NO:37 comprises amino acids Ala-1, Arg-4, Leu-5, Glu-8, Ala-11, Trp-12, and Asp-15 of SEQ ID NO:37.

In certain embodiments, 0 to 6 amino acids on the non-interacting face of SEQ ID NO:37 are substituted with an amino acid selected from the group consisting of alanine, D-alanine, α-aminoisobutyric acid, N-methyl glycine, serine, a substituted alanine, and a glycine derivative.

In certain embodiments, one or more of amino acids Leu-2, Ser-3, Ala-6, Gln-7, Arg-9, Lys-10, Arg-13, and Lys-14 of SEQ ID NO:37 are substituted with an alpha-methylated or alpha-ethylated natural amino acids. In certain embodiments, one or more of amino acids Leu-2, Ser-3, Ala-6, Gln-7, Arg-9, Lys-10, Arg-13, and Lys-14 of SEQ ID NO:37 are substituted with an amino acid selected from the group consisting of L-alanine, D-alanine, α-aminoisobutyric acid, N-methyl glycine, serine, a substituted alanine, and a glycine derivative.

In certain embodiments, one or more of amino acids Ala-1, Arg-4, Leu-5, Glu-8, Ala-11, Trp-12, and Asp-15 of SEQ ID NO:37 are substituted with an alpha-methylated or alpha-ethylated natural amino acids. In certain embodiments, one or more of amino acids Ala-1, Arg-4, Leu-5, Glu-8, Ala-11, Trp-12, and Asp-15 of SEQ ID NO:37 are substituted with an amino acid selected from the group consisting of L-alanine, D-alanine, α-aminoisobutyric acid, N-methyl glycine, serine, a substituted alanine, and a glycine derivative.

In certain embodiments, 0 to 5 amino acids in SEQ ID NO:37 are removed from the C-terminal or are removed and replaced with 1 to 6 amino acids from the group consisting of alanine, D-alanine, α-aminoisobutyric acid, N-methyl glycine, serine, a substituted alanine, and a glycine derivative.

In certain embodiments, (i) overall hydrophobicity of the peptide is reduced relative to a peptide of SEQ ID NO:37; (ii) overall positive charge of the peptide is reduced relative to a peptide of SEQ ID NO:37; or (iii) a combination of (i) and (ii).

In a fourth aspect, provided herein is a peptide comprising: a modified amino acid sequence of the sequence set forth in SEQ ID NO:38, wherein one or more amino acids of SEQ ID NO:38 are substituted by another amino acid; wherein the modified amino acid sequence comprises at least one peptide structure stabilizing modification; and wherein the peptide binds to and inhibits Ubiquitin Activating Enzyme 6 (UBA6).

In certain embodiments, the peptide structure stabilizing modification comprises substitution of at least two amino acids of the sequence of SEQ ID NO:38 with non-natural amino acids, wherein the non-natural amino acids comprise olefinic side chains. In certain embodiments, the peptide structure stabilizing modification is a hydrocarbon staple/stitch, a lactam staple/stitch; a UV-cycloaddition staple/stitch; an oxime staple/stitch; a thioether staple/stitch; a double-click staple/stitch; a bis-lactam staple/stitch; a bis-arylation staple/stitch; or a combination of any two or more thereof. In certain embodiments, the peptide structure stabilizing modification is a stich.

In certain embodiments, the peptide structure stabilizing modification is a staple. In certain embodiments, the staple is at one or more of two positions in the amino acid sequence, wherein the two positions are i and i+3; i and i+4; or i and i+7. In certain embodiments, the staple comprises an amino acid substitution at each of the two positions, wherein each of the amino acid substitutions is a substitution with a non-natural amino, wherein the non-natural amino acid comprises olefinic side chain.

In certain embodiments in which the peptide comprises non-natural amino acids comprising olefinic side chains, the non-natural amino acids comprising olefinic side chains are selected from the group consisting of: S-pentenyl alanine, R-octenyl alanine; R-propenylalanine, S-pentenylalanine; R-pentenylalanine, S-pentenylalanine; Bis-pentenylglycine, S-pentenylalanine, R-octenylalanine; and Bis-pentenylglycine, S-octenylalanine, and R-octenylalanine.

In certain embodiments, the modified amino acid sequence comprises zero, one, two, three, four, or five amino acid substitutions at amino acid positions selected from the group consisting of Met-1, Ala-2, Ala-3, Ser-4, Leu-6, Asn-9, Leu-10, Arg-12, Leu-13, Ser-15, Arg-16, and Cys-17 of SEQ ID NO:38.

In certain embodiments, the modified amino acid sequence comprises zero, one, or two conservative amino acid substitutions at amino acid positions selected from the group consisting of Arg-5, Glu-7, Leu-8, Val-11, and Leu-14 of SEQ ID NO:38.

In certain embodiments, the one or more amino acids that are substituted by another amino acid are on the E1 non-interacting face of SEQ ID NO:38. In certain embodiments, the non-interacting face of SEQ ID NO:38 comprises amino acids Met-1, Ala-2, Ala-3, Ser-4, Leu-6, Asn-9, Leu-10, Arg-12, Leu-13, Ser-15, Arg-16, and Cys-17 of SEQ ID NO:38.

In certain embodiments, 0 to 6 amino acids on the non-interacting face of SEQ ID NO:38 are substituted with an amino acid selected from the group consisting of alanine, D-alanine, α-aminoisobutyric acid, N-methyl glycine, serine, a substituted alanine, and a glycine derivative.

In certain embodiments, one or more of amino acids Arg-5, Glu-7, Leu-8, Val-11, and Leu-14 of SEQ ID NO:38 are substituted with an alpha-methylated or alpha-ethylated natural amino acids. In certain embodiments, one or more of amino acids Arg-5, Glu-7, Leu-8, Val-11, and Leu-14 of SEQ ID NO:38 are substituted with an amino acid selected from the group consisting of L-alanine, D-alanine, α-aminoisobutyric acid, N-methyl glycine, serine, a substituted alanine, and a glycine derivative.

In certain embodiments, one or more of amino acids Met-1, Ala-2, Ala-3, Ser-4, Leu-6, Asn-9, Leu-10, Arg-12, Leu-13, Ser-15, Arg-16, and Cys-17 of SEQ ID NO:38 are substituted with an alpha-methylated or alpha-ethylated natural amino acids. In certain embodiments, one or more of amino acids Met-1, Ala-2, Ala-3, Ser-4, Leu-6, Asn-9, Leu-10, Arg-12, Leu-13, Ser-15, Arg-16, and Cys-17 of SEQ ID NO:38 are substituted with an amino acid selected from the group consisting of L-alanine, D-alanine, α-aminoisobutyric acid, N-methyl glycine, serine, a substituted alanine, and a glycine derivative.

In certain embodiments, 0 to 5 amino acids in SEQ ID NO:38 are removed from the C-terminal or are removed and replaced with 1 to 6 amino acids from the group consisting of alanine, D-alanine, α-aminoisobutyric acid, N-methyl glycine, serine, a substituted alanine, and a glycine derivative.

In certain embodiments, (i) overall hydrophobicity of the peptide is reduced relative to a peptide of SEQ ID NO:38; (ii) overall positive charge of the peptide is reduced relative to a peptide of SEQ ID NO:38; or (iii) a combination of (i) and (ii).

In a fifth aspect, provided herein is a derivative of the peptide of the first aspect, wherein the peptide derivative comprises an electrophilic warhead. In certain embodiments, the electrophilic warhead is at amino acid position $A_7$, $A_8$, or $A_{11}$. In certain embodiments, the electrophilic warhead is at the N-terminus of the peptide. In certain embodiments, the electrophilic warhead is not at the N-terminus of the peptide.

In certain embodiments, the electrophilic warhead is a non-natural amino acid bearing an electrophilic group. In certain embodiments, the non-natural amino acid bearing an electrophilic group has an electrophilic acrylamide or substituted acrylamide linked to the polypeptide backbone. In certain embodiments, the non-natural amino acid bearing an electrophilic group is selected from the group consisting of: (S)-1-acryloylpyrrolidine-3-carboxamide; 1-acrylopiperidine-4-carboxamide, (R)-1 acryloylpiperidine-3-carboxamide; (S)-1-acryloylpiperidine-3-carboxamide; (S)-1-acryloylpyyrolidine-2-carboxamide; (R)-1-acryloylpyrrolidine-2-carboxamide; (E)-4-(dimethylamino)but-2-enamide; acrylamide; aziridine, diaziridine, azetidine, pyrrolidine, imidazolidine, pyrazolidine, oxazolidine, isoxazolidine, thiazolidine, isothiazolidine, piperidine, piperazine, morpholine, thiomorpholine, azepaneazirine, diazirine, azete, pyrrole, imidazole, pyrazole, oxazole, isoxazole, thiazole, isothiazole, pyridine, diazines, oxazine, thiazine, azepine phenyl (aniline); naphthalene, anthracene, phenanthrene, indole, isoindole, indolizine, quinolone, isoquinoline, quinoxaline, phthalzine, quinazoline, purine, carbazole, indazole, benzimidazole, azaindole, α-cyanoacrylamide, propiolamide, trans 4-dimethylamino-2-butenamide, trans 4-piperidinyl-2-butenamide, a substituted acrylamide, and a vinyl-sulfonamide. In certain embodiments, the electrophilic warhead is diamino butanoic acid terminating in bromoacetyl or diamino butanoic acid terminating in acrylamide. In certain embodiments, the electrophilic warhead is a cysteine-reactive D-nipecotic acid moiety. In certain embodiments, the electrophilic warhead is a cysteine-reactive moiety.

In certain embodiments, the derivative comprises the sequence set forth in any one of SEQ ID NOs:392, 428, 464, 500, 680, 716, 752, and 788. In certain embodiments, the derivative comprises the sequence set forth in SEQ ID NO:680. In certain embodiments, the derivative comprises the sequence set forth in SEQ ID NO:752. In certain embodiments, the derivative comprises the sequence set forth in any one of SEQ ID NOs: 393, 429, 465, 501, 681, 717, 753, and 789. In certain embodiments, the derivative comprises the sequence set forth in any one of SEQ ID NOs:367, 403, 439, 655, 727, and 757. In certain embodiments, the derivative comprises the sequence set forth in SEQ ID NO:727. In certain embodiments, the derivative comprises the sequence set forth in any one of SEQ ID NOs:833-836 and 841-844. In certain embodiments, the derivative comprises the sequence set forth in SEQ ID NO:841. In certain embodiments, the derivative comprises the sequence set forth in SEQ ID NO:842. In certain embodiments, the derivative comprises the sequence set forth in SEQ ID NO:844.

In certain embodiments, the derivative covalently binds to UBA1.

In a sixth aspect, provided herein is a pharmaceutical composition comprising the peptide of any one of the first through fourth aspects or the derivative peptide of the fifth aspect, and a pharmaceutically acceptable carrier.

In a seventh aspect, provided herein is a method of treating an E1-expressing or E1-dependent disease in a human subject in need thereof, the method comprising administering to the human subject a therapeutically effective amount of the peptide of any one of the first through fourth aspects, the derivative peptide of the fifth aspect, or the pharmaceutical composition of the sixth aspect. In certain embodiments, the E1-expressing or E1-dependent disease is cancer. In certain embodiments, the E1-expressing or E1-dependent disease is a hematological malignancy, a solid tumor, an antibody-mediated transplant rejection, an autoimmune disorder, or an inflammatory disorder.

In an eighth aspect, the disclosure features a composition comprising a means for inhibiting the interaction between a Ubiquitin activating enzyme (E1) and a ubiquitin conjugating enzyme (E2). In some instances, the means for inhibiting the interaction is a stabilized (e.g., stapled, stitched) peptide that inhibits the interaction between an E1 and an E2. In certain cases, the means for inhibiting the interaction is a stabilized peptide that mimics an E2 hA (see, e.g., Tables 1 to 6). In some instances, the means for inhibiting the interaction is a peptide in Tables 7, 8, or 9, or a variant thereof. In one case, the means for inhibiting the interaction is a stabilized peptide that is a stapled peptide based on the UBE2A/UBE2B E2 hA (i.e., SEQ ID NO:4). In one case, the means for inhibiting the interaction is a stabilized peptide is SAH-UBE2A-11 (SEQ ID NO:132) or a variant thereof. In one case, the means for inhibiting the interaction is a stabilized peptide comprises the sequence set forth in SEQ ID NO:65, 96, or 101 or a variant thereof. In some instances, the composition is a pharmaceutical composition and comprises a pharmaceutically acceptable carrier, excipient, or diluent.

In a ninth aspect, the disclosure provides a method of treating an E1-expressing or E1-dependent disease in a human subject in need thereof. The method comprises administering to the human subject a therapeutically effective amount of a composition comprising a means for inhibiting the interaction between a Ubiquitin activating enzyme (E1) and a ubiquitin conjugating enzyme (E2). In some instances, the means for inhibiting the interaction is a stabilized (e.g., stapled, stitched) peptide that inhibits the interaction between an E1 and an E2. In certain cases, the means for inhibiting the interaction is a stabilized peptide that mimics an E2 hA (see, e.g., Tables 1 to 6). In some instances, the means for inhibiting the interaction is a peptide in Tables 7, 8, or 9, or a variant thereof. In one case, the means for inhibiting the interaction is a stabilized peptide that is a stapled peptide based on the UBE2A/UBE2B E2 hA (i.e., SEQ ID NO:4). In one case, the means for inhibiting the interaction is a stabilized peptide is SAH-UBE2A-11 (SEQ ID NO:132) or a variant thereof. In one case, the means for inhibiting the interaction is a stabilized peptide comprising the sequence set forth in SEQ ID NO:65, 96, or 101 or a variant thereof. In some instances, the composition is a pharmaceutical composition and comprises a pharmaceutically acceptable carrier, excipient, or diluent. In certain instances, the E1-expressing or E1-dependent disease is a cancer. In certain instances, the E1-expressing or E1-dependent disease is a hematological malignancy, solid tumor, an antibody-mediated transplant rejection, an autoimmune disorder, an inflammatory disorder, or a disease of pathologic cell survival.

BRIEF DESCRIPTION OF THE DRAWINGS

FIGS. 1A-1C: design of UBA1-binding stapled peptides. FIG. 1A illustrates the structural basis of UBA1 inhibitor peptide design. Depicted is a crystal structure of E2 enzyme Ubc15 binding to *S. pombe* E1 enzyme Ube1 (PDB ID: 5KNL). Ubc15 is shown in ribbon depiction and Ube1 in surface depiction. The dashed box indicates the alpha helix of E2 that forms the basis for designing the inhibitor peptides. FIGS. 1B-1C: illustrate 'i+4' staple walks (FIG. 1B; staple positions 2-9) and 'i+7' staple walks (FIG. 1C; staple positions 10-15) along amino acids 5-18 of SEQ ID NO:40. The wheel depiction represents the peptide portion expected to be alpha-helical with E2 helix A (hA) peptide residues indicated by the single-letter amino acid code and their position in SEQ ID NO:40.

FIG. 2 shows inhibition of E1-mediated ubiquitin transfer to E2 by select E2 hA stapled peptides (1-15 correspond to SEQ ID NOs: 40-54, respectively). Top panel is a quantification of three independent band-shift experiments. One representative band-shift experiment is shown in the bottom panel.

FIG. 4A is a graph quantifying three independent inhibition experiments. FIG. 4B depicts one representative experiment.

FIGS. 6A-6D identify which residues are important for and contribute to target binding as determined by alanine scanning mutagenesis. FIG. 6A depicts sequences of amino acid sequences corresponding to amino acids 1 to 17 of SEQ ID NO:4; SAH-UBE2A (SEQ ID NO:132); and variant SAH-UBE2A stapled peptides with mutations at the 1st (B1A), 2nd (S2A), 3rd (T3A), fourth (P4A), sixth (R6A), 7th (R7A), 8th (R8A), 9th (L9A), 10th (B10A), 11th (R11A), 13th (F13A), 14th (K14A), 15th (R15A), 16th (L16A), or 17th (Q17A) amino acid of SAH-UBE2A (SEQ ID NO:132). FIG. 6A discloses SEQ ID NOS 1321, 132, and 1322-1336, respectively, in order of appearance. FIG. 6B shows silver staining of in vitro thioester transfer inhibition assay samples run on Bis-Tris protein gels under nonreducing conditions. In vitro thioester transfer inhibition assays were performed with recombinant human E1 activating protein UBA1, E2 enzyme, ubiquitin, Mg-ATP, and SAH-UBE2A-11 stapled peptide mutants. Free E2 is visualized at 17 kDa; E2~ubiquitin conjugate is visualized at ~26 kDa. Top panel is a quantification of the bands in the bottom panel. FIG. 6C depicts the locations of the amino acid positions identified as particularly important to peptide inhibitory activity based on alanine mutagenesis. Contributory amino acid positions are marked with a black star. FIG. 6D depicts the locations of important amino acid positions, relative to the predicted UBA1 binding surface. Amino acid positions predicted to directly interact with UBA1 are labeled and marked with black stars on a model of UBE2A helix 1 docked to UBA1 (PDB ID: 6DC6).

FIG. 7A depicts amino acid sequences corresponding to amino acids 1 to 17 of SEQ ID NO:4; SAH-UBE2A-11 (SEQ ID NO:132), and sequences of variant SAH-UBE2A-11 stapled peptides with R to E substitutions at the 6$^{th}$ (R6E), 7$^{th}$ (R7E), or 8th (R8E) amino acid of SAH-UBE2A-11 (SEQ ID NO:132). FIG. 7A discloses SEQ ID NOS 1321, 132, and 1337-1339, respectively, in order of appearance. FIG. 7B shows silver staining of in vitro thioester transfer inhibition assay samples run on Bis-Tris protein gels under nonreducing conditions. In vitro thioester transfer inhibition assays were performed with recombinant human E1 activating protein UBA1, E2 enzyme, ubiquitin, Mg-ATP, and SAH-UBE2A-11 stapled peptide mutants. Free E2 is visualized at 17 kDa; E2~ubiquitin conjugate is visualized at ~26 kDa. Top panel is a quantification of the bands in the bottom panel. FIG. 7C depicts the location of the cationic amino acid position identified as important to peptide inhibitory activity (marked with a black star). FIG. 7D depicts the locations of the key cationic amino acid position, relative to the predicted UBA1 binding surface, as labeled and marked with a black star on a model of UBE2A helix 1 docked to UBA1 (PDB ID: 6DC6).

DETAILED DESCRIPTION

Figure 1A:
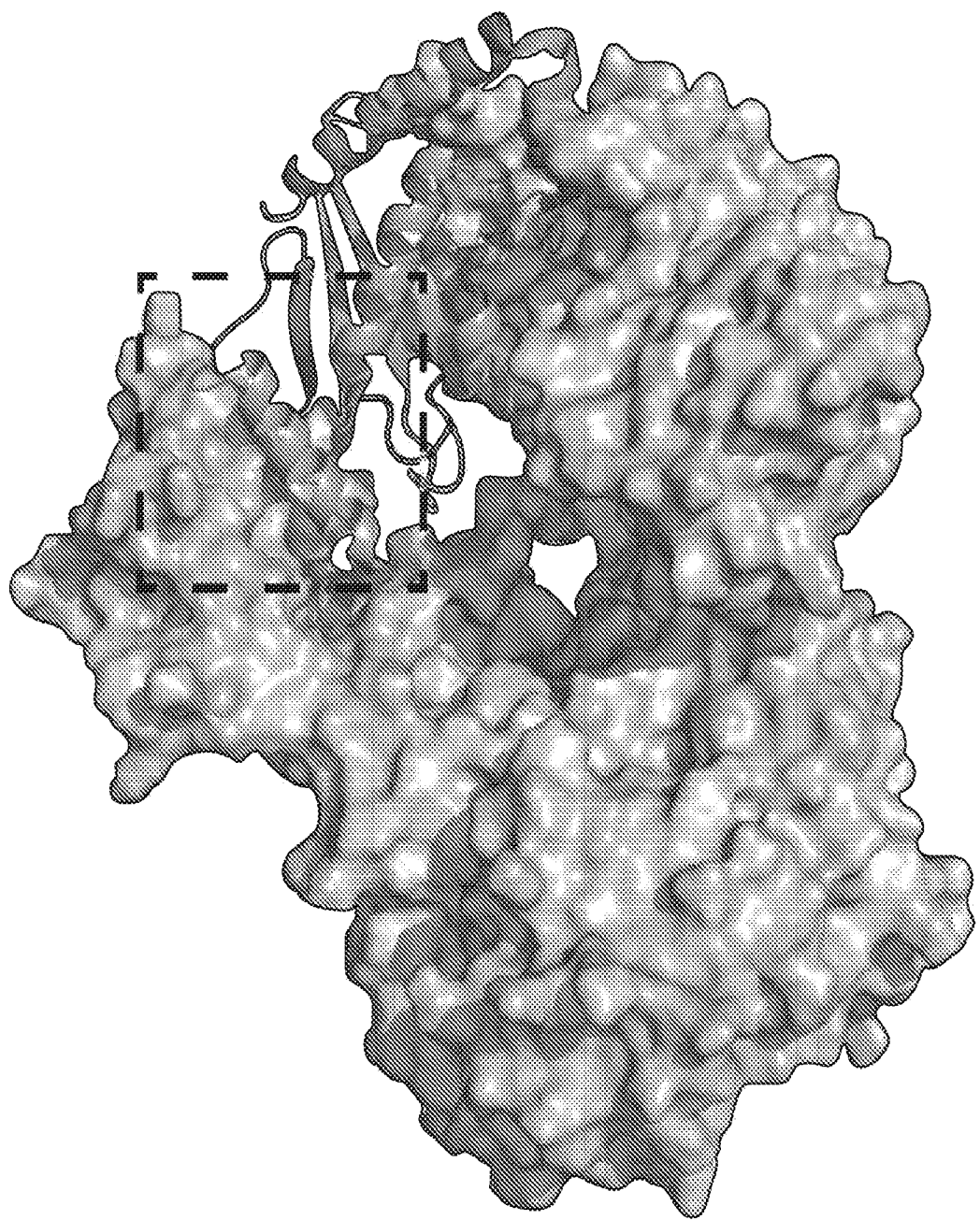
Figure 3:
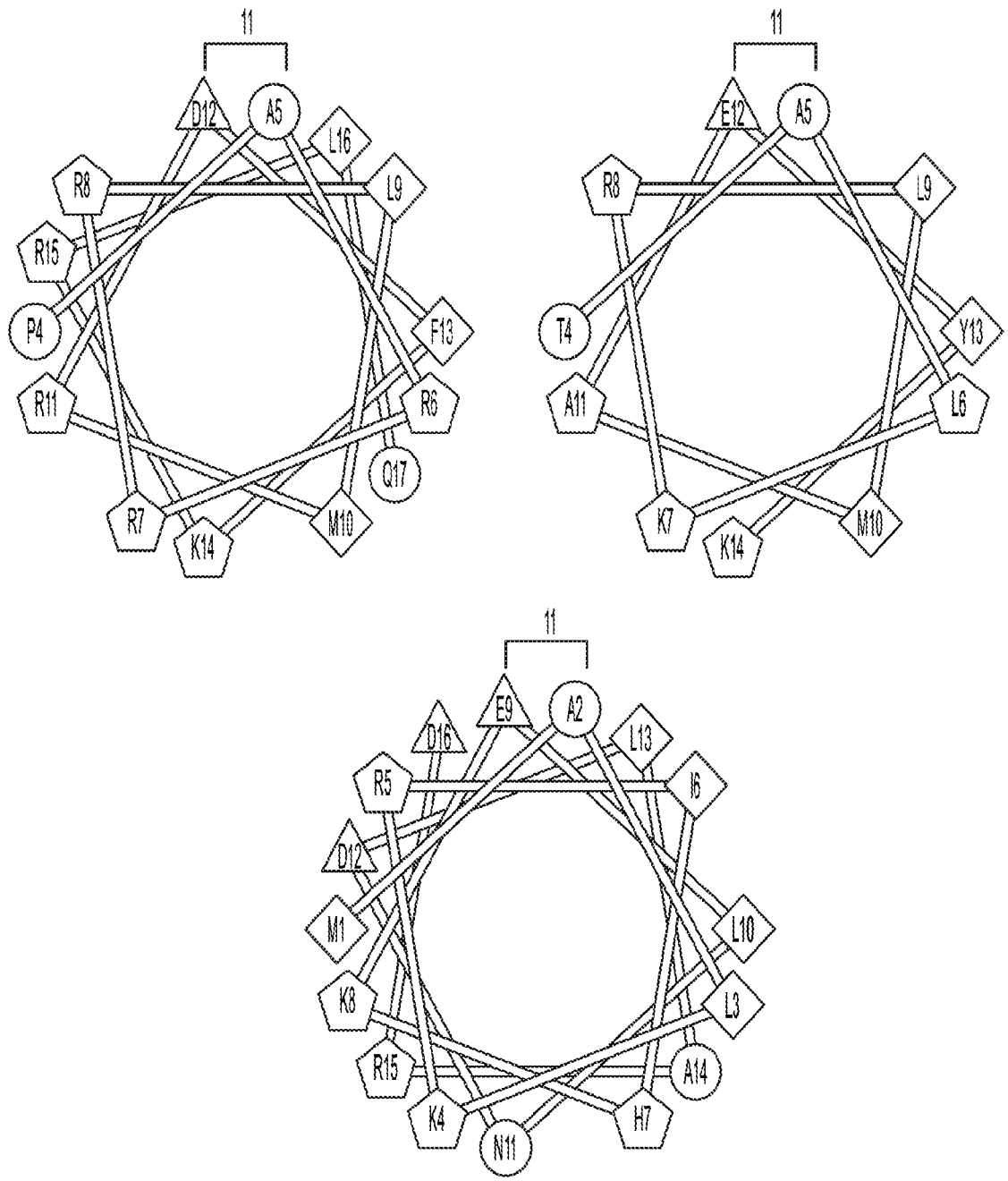
FIG. 3 depicts an exemplary staple position in the helical portion of human E2 hA, including stapled peptides SAH-UBE2A-11 (left panel), SAH-UBE2G2-11 (middle panel), and SAH-UBE2D2-11 (right panel).

E1 enzymes activate Ub by first catalyzing the adenylation of the Ub C-terminus and then forming a high-energy thioester bond between the Ub C-terminus and the E1 catalytic cysteine. E1s then charge E2s by binding to E2 and transferring Ub from the E1 catalytic cysteine to the E2 catalytic cysteine. E2s in turn complex with ubiquitin ligases (E3s) and substrate proteins to transfer the Ub C-terminal carboxyl group covalently onto substrate proteins. The interaction between E1 and E2 buries 3000 Å$^2$ of protein surface area, 1000 Å$^2$ of which is buried in the interface between helix A of the E2 (E2 hA) and the E1 ubiquitin fold domain (E1 UFD). The interaction between E1 and E2 hA is thus important in the formation of the E1-E2 encounter complex. This disclosure provides structurally stabilized (e.g., stapled) alpha-helical peptides mimicking E2 hA that can act as direct inhibitors of E1, such as by competitive inhibition of the E1-E2 interaction. In certain aspects, the structurally stabilized (e.g., stapled) E2 hA peptides bind to the E1 UFD. This disclosure also provides warhead-bearing versions of the stabilized (e.g., stapled) E2 hA peptides described herein, which can covalently bind to a cognate E1. Without being bound by any theory, the stabilized E2 hAs provided herein prevent E1 from charging E2, thus representing a mechanism of inhibiting E1. This disclosure also features methods for using such stabilized peptides (or warhead-bearing versions thereof) alone or in combination with other therapeutic agents in the treatment of E1-dependent and/or -expressing cancers (e.g., hematologic malignancies, solid tumors, or other specific cancers described herein) and other diseases of pathologic cell survival (e.g., antibody-mediated transplant rejection, autoimmune disorders, or inflammatory disorders).

E1 Proteins

The amino acid sequence of human UBA1 is provided below (GenBank Accession No. NP 695012):

```
                                                              (SEQ ID NO: 845)
  1    MSSSPLSKKR  RVSGPDPKPG  SNCSPAQSVL  SEVPSVPTNG  MAKNGSEADI  DEGLYSRQLY

61    VLGHEAMKRL  QTSSVLVSGL  RGLGVEIAKN  IILGGVKAVT  LHDQGTAQWA  DLSSQFYLRE

121    EDIGKNRAEV  SQPRLAELNS  YVPVTAYTGP  LVEDFLSGFQ  VVVLTNTPLE  DQLRVGEFCH
```

-continued

```
 181    NRGIKLVVAD TRGLFGQLFC DFGEEMILTD SNGEQPLSAM VSMVTKDNPG VVTCLDEARH

241    GFESGDFVSF SEVQGMVELN GNQPMEIKVL GPYTFSICDT SNFSDYIRGG IVSQVKVPKK

301    ISFKSLVASL AEPDFVVTDF AKFSRPAQLH IGFQALHQFC AQHGRPPRPR NEEDAAELVA

361    LAQAVNARAL PAVQQNNLDE DLIRKLAYVA AGDLAPINAF IGGLAAQEVM KACSGKFMPI

421    MQWLYFDALE CLPEDKEVLT EDKCLQRQNR YDGQVAVFGS DLQEKLGKQK YFLVGAGAIG

481    CELLKNFAMI GLGCGEGGEI IVTDMDTIEK SNLNRQFLFR PWDVTKLKSD TAAAAVRQMN

541    PHIRVTSHQN RVGPDTERIY DDDFFQNLDG VANALDNVDA RMYMDRRCVY YRKPLLESGT

601    LGTKGNVQVV IPFLTESYSS SQDPPEKSIP ICTLKNFPNA IEHTLQWARD EFEGLFKQPA

661    ENVNQYLTDP KFVERTLRLA GTQPLEVLEA VQRSLVLQRP QTWADCVTWA CHHWHTQYSN

721    NIRQLLHNFP PDQLTSSGAP FWSGPKRCPH PLTFDVNNPL HLDYVMAAAN LFAQTYGLTG

781    SQDRAAVATF LQSVQVPEFT PKSGVKIHVS DQELQSANAS VDDSRLEELK ATLPSPDKLP

841    GFKMYPIDFE KDDDSNFHMD FIVAASNLRA ENYDIPSADR HKSKLIAGKI IPAIATTTAA

901    VVGLVCLELY KVVQGHRQLD SYKNGFLNLA LPFFGFSEPL AAPRHQYYNQ EWTLWDRFEV

961    QGLQPNGEEM TLKQFLDYFK TEHKLEITML SQGVSMLYSF FMPAAKLKER LDQPMTEIVS

1021    RVSKRKLGRH VRALVLELCC NDESGEDVEV PYVRYTIR.
```

The UFD of human UBA1 consists of amino acid residues 950 to 1058 of SEQ ID NO:845.

The amino acid sequence of human UBA2 is provided below (GenBank Accession No. NP_005490):

```
                                                          (SEQ ID NO: 846)
  1     MALSRGLPRE LAEAVAGGRV LVVGAGGIGC ELLKNLVLTG FSHIDLIDLD TIDVSNLNRQ

61     FLFQKKHVGR SKAQVAKESV LQFYPKANIV AYHDSIMNPD YNVEFFRQFI LVMNALDNRA

121     ARNHVNRMCL AADVPLIESG TAGYLGQVTT IKKGVTECYE CHPKPTQRTF PGCTIRNTPS

181     EPIHCIVWAK YLFNQLFGEE DADQEVSPDR ADPEAAWEPT EAEARARASN EDGDIKRIST

241     KEWAKSTGYD PVKLFTKLFK DDIRYLLTMD KLWRKRKPPV PLDWAEVQSQ GEETNASDQQ

301     NEPQLGLKDQ QVLDVKSYAR LFSKSIETLR VHLAEKGDGA ELIWDKDDPS AMDFVTSAAN

361     LRMHIFSMNM KSRFDIKSMA GNIIPAIATT NAVIAGLIVL EGLKILSGKI DQCRTIFLNK

421     QPNPRKKLLV PCALDPPNPN CYVCASKPEV TVRLNVHKVT VLTLQDKIVK EKFAMVAPDV

481     QIEDGKGTIL ISSEEGETEA NNHKKLSEFG IRNGSRLQAD DFLQDYTLLI NILHSEDLGK

541     DVEFEVVGDA PEKVGPKQAE DAAKSITNGS DDGAQPSTST AQEQDDVLIV DSDEEDSSNN

601     ADVSEEERSR KRKLDEKENL SAKRSRIEQK EELDDVIALD.
```

The UFD of human UBA2 consists of amino acid residues 444 to 552 of SEQ ID NO:846.

The amino acid sequence of human UBA3 is provided below (GenBank Accession No. NP_003959):

```
                                                          (SEQ ID NO: 847)
  1     MADGEEPEKK RRRIEELLAE KMAVDGGCGD TGDWEGRWNH VKKFLERSGP FTHPDFEPST

61     ESLQFLLDTC KVLVIGAGGL GCELLKNLAL SGFRQIHVID MDTIDVSNLN RQFLFRPKDI

121     GRPKAEVAAE FLNDRVPNCN VVPHFNKIQD FNDTFYRQFH IIVCGLDSII ARRWINGMLI

181     SLLNYEDGVL DPSSIVPLID GGTEGFKGNA RVILPGMTAC IECTLELYPP QVNFPMCTIA

241     SMPRLPEHCI EYVRMLQWPK EQPFGEGVPL DGDDPEHIQW IFQKSLERAS QYNIRGVTYR
```

```
301    LTQGVVKRII PAVASTNAVI AAVCATEVFK IATSAYIPLN NYLVFNDVDG LYTYTFEAER

361    KENCPACSQL PQNIQFSPSA KLQEVLDYLT NSASLQMKSP AITATLEGKN RTLYLQSVTS

421    IEERTRPNLS KTLKELGLVD GQELAVADVT TPQTVLFKLH FTS.
```

The UFD of human UBA3 consists of amino acid residues 445 to 561 of SEQ ID NO:847.

The amino acid sequence of human UBA6 is provided below (GenBank Accession No. NP_060697):

```
                                                        (SEQ ID NO: 848)
  1    MEGSEPVAAH QGEEASCSSW GTGSTNKNLP IMSTASVEID DALYSRQRYV LGDTAMQKMA

61    KSHVFLSGMG GLGLEIAKNL VLAGIKAVTI HDTEKCQAWD LGTNFFLSED DVVNKRNRAE

121    AVLKHIAELN PYVHVTSSSV PFNETTDLSF LDKYQCVVLT EMKLPLQKKI NDFCRSQCPP

181    IKFISADVHG IWSRLFCDFG DEFEVLDTTG EEPKEIFISN ITQANPGIVT CLENHPHKLE

241    TGQFLTFREI NGMTGLNGSI QQITVISPFS FSIGDTTELE PYLHGGIAVQ VKTPKTVFFE

301    SLERQLKHPK CLIVDFSNPE APLEIHTAML ALDQFQEKYS RKPNVGCQQD SEELLKLATS

361    ISETLEEKPD VNADIVHWLS WTAQGFLSPL AAAVGGVASQ EVLKAVTGKF SPLCQWLYLE

421    AADIVESLGK PECEEFLPRG DRYDALRACI GDTLCQKLQN LNIFLVGCGA IGCEMLKNFA

481    LLGVGTSKEK GMITVTDPDL IEKSNLNRQF LFRPHHIQKP KSYTAADATL KINSQIKIDA

541    HLNKVCPTTE TIYNDEFYTK QDVIITALDN VEARRYVDSR CLANLRPLLD SGTMGTKGHT

601    EVIVPHLTES YNSHRDPPEE EIPFCTLKSF PAAIEHTIQW ARDKFESSFS HKPSLFNKFW

661    QTYSSAEEVL QKIQSGHSLE GCFQVIKLLS RRPRNWSQCV ELARLKFEKY FNHKALQLLH

721    CFPLDIRLKD GSLFWQSPKR PPSPIKFDLN EPLHLSFLQN AAKLYATVYC IPFAEEDLSA

781    DALLNILSEV KIQEFKPSNK VVQTDETARK PDHVPISSED ERNAIFQLEK AILSNEATKS

841    DLQMAVLSFE KDDDHNGHID FITAASNLRA KMYSIEPADR FKTKRIAGKI IPAIATTTAT

901    VSGLVALEMI KVTGGYPFEA YKNCFLNLAI PIVVFTETTE VRKTKIRNGI SFTIWDRWTV

961    HGKEDFTLLD FINAVKEKYG IEPTMVVQGV KMLYVPVMPG HAKRLKLTMH KLVKPTTEKK

1021   YVDLTVSFAP DIDGDEDLPG PPVRYYFSHD TD.
```

The UFD of human UBA6 consists of amino acid residues 950 to 1052 of SEQ ID NO:848.

The amino acid sequence of *S. pombe* UBA1 is provided below (GenBank Accession No. CAA22354.2):

```
                                                        (SEQ ID NO: 49)
  1    MSNNMNIDQT DQNTIDEGLY SRQLYVLGHE AMKQMSQSNV LIIGCKGLGV EIAKNVCLAG

61    VKSVTLYDPQ PTRIEDLSSQ YFLTEDDIGV PRAKVTVSKL AELNQYVPVS VVDELSTEYL

121    KNFKCVVVTE TSLTKQLEIN DFTHKNHIAY IAADSRGLFG SIFCDFGENF ICTDTDGNEP

181    LTGMIASITD DGVVTMLEET RHGLENGDFV KFTEVKGMPG LNDGTPRKVE VKGPYTFSIG

241    SVKDLGSAGY NGVFTQVKVP TKISFKSLRE SLKDPEYVYP DFGKMMRPPQ YHIAFQALSA

301    FADAHEGSLP RPRNDIDAAE FFEFCKKIAS TLQFDVELDE KLIKEISYQA RGDLVAMSAF

361    LGGAVAQEVL KATTSKFYPL KQYFYFDSLE SLPSSVTISE ETCKPRGCRY DGQIAVFGSE

421    FQEKIASLST FLVGAGAIGC EMLKNWAMMG VATGESGHIS VTDMDSIEKS NLNRQFLFRP

481    RDVGKLKSEC ASTAVSIMNP SLTGKITSYQ ERVGPESEGI FGDEFFEKLS LVTNALDNVE

541    ARMYVDRRCV FFEKPLLESG TLGTKGNTQV VVPHLTESYG SSQDPPEKSF PICTLKNFPN

601    RIEHTIAWAR DLFEGLFKQP IDNVNMYLSS PNFLETSLKT SSNPREVLEN IRDYLVTEKP
```

```
661    LSFEECIMWA  RLQFDKFFNN  NIQQLLFNFP  KDSVTSTGQP  FWSGPKRAPT  PLSFDIHNRE

721    HFDFIVAAAS  LYAFNYGLKS  ETDPAIYERV  LAGYNPPPFA  PKSGIKIQVN  ENEEAPETAA

781    NKDKQELKSI  ADSLPPPSSL  VGFRLTPAEF  EKDDDSNHHI  DFITAASNLR  AMNYDITPAD

841    RFKTKFVAGK  IVPAMCTSTA  VVSGLVCLEL  VKLVDGKKKI  EEYKNGFFNL  AIGLFTFSDP

901    IASPKMKVNG  KEIDKIWDRY  NLPDCTLQEL  IDYFQKEEGL  EVTMLSSGVS  LLYANFQPPK

961    KLAERLPLKI  SELVEQITKK  KLEPFRKHLV  LEICCDDANG  EDVEVPFICI  KL
```

The UFD of *S. pombe* UBA1 consists of amino acid residues 911 to 1012 of SEQ ID NO:849.

E2 Helix A Peptides

Exemplary E2 hA peptides of this disclosure are the peptides of Tables 1-5. The amino acids on the interacting face of the E2 hA peptide contribute to interaction between the E2 hA peptide and the E1, e.g., UBA1, UBA6, UBA2, or UBA3. In contrast, the amino acids on the non-interacting face of the E2 hA peptide are not involved in direct interaction between the E2 hA peptide and the E1, e.g., UBA1, UBA6, UBA2, or UBA3. Residues involved in direct interaction of the E2 hA peptide to its cognate E1 enzyme (e.g., UBA1 for SEQ ID NOs:1-34, UBA6 for SEQ ID NO:38, UBA2 for SEQ ID NO:37, and UBA3 for SEQ ID NOs:35 and 36) are in bold in Tables 1-5; all other amino acids are not involved in direct interaction (or predicted to not be involved in direct interaction) to its cognate E1 enzyme.

The disclosure provides E2 hA peptides that bind to and inhibit the UBA1 E1. In certain embodiments, the E2 hA peptides bind to the UBA1 E1 UFD. Exemplary UBA1-binding E2 hA peptides of this disclosure are provided in Table 1 (from *S. pombe*) and Table 2 (from *H. sapiens*). The consensus position numbering used for UBA1-binding peptides ($A_\#$) is provided in Table 1 and Table 2 below. Methods for assessing a peptide's inhibition of UBA1 are known in the art and described herein.

The residues of Ubc4 E2 hA (SEQ ID NO: 1) that directly interact with, e.g., bind to, UBA1 are amino acid consensus positions $A_1$, $A_3$, $A_4$, $A_7$, $A_{10}$, and $A_{11}$. For example, the Ubc4 E2 hA residues that directly interact with UBA1, in the context of the position numbering for SEQ ID NO:1, are: Met-1 (i.e., $A_1$), Leu-3 (i.e., $A_3$), Lys-4 (i.e., $A_4$), Asn-7 (i.e., $A_7$), Leu-10 (i.e., $A_{10}$), and Ala-11 (i.e., $A_{11}$) (see Lv et al., 2017, Mol. Cell, 65(4):699-714).

The residues of Ubc4 E2 hA (i.e., SEQ ID NO: 1) that do not engage in direct interaction with, e.g., binding to, UBA1 are: $A_2$, $A_5$, $A_6$, $A_8$, $A_9$, $A_{12}$, $A_{13}$, $A_{14}$, $A_{15}$, and $A_{16}$. For example, Ubc4 E2 hA residues that do not engage in direct interaction with UBA1, in the context of the position numbering for SEQ ID NO:1, are: Ala-2 (i.e., $A_2$), Arg-5 (i.e., $A_5$), Ile-6 (i.e., $A_6$), Arg-8 (i.e., $A_8$), Glu-9 (i.e., $A_9$), Asp-12 (i.e., $A_{12}$), Leu-13 (i.e., $A_{13}$), Gly-14 (i.e., $A_{14}$), Lys-15 (i.e., $A_{15}$), and Asp-16 (i.e., $A_{16}$).

The residues of Ubc15 E2 hA (SEQ ID NO: 2) that directly interact with, e.g., bind to, UBA1 are amino acid consensus positions $A_{-4}$, $A_{-3}$, $A_{-2}$, $A_{-1}$, $A_3$, $A_7$, $A_8$, $A_{10}$, $A_{11}$, and $A_{14}$. For example, the Ubc15 E2 hA residues that directly interact with UBA1, in the context of the position numbering for SEQ ID NO:2, are: Met-1 (i.e., $A_{-4}$), Pro-2 (i.e., $A_{-3}$), Ser-3 (i.e., $A_{-2}$), Ser-4 (i.e., $A_{-1}$), Glu-7 (i.e., $A_3$), Arg-11 (i.e., $A_7$), Lys-12 (i.e., $A_8$), Leu-14 (i.e., $A_{10}$), Lys-15 (i.e., $A_{11}$), and Gln-18 (i.e., $A_{14}$) (see Lv et al., 2017, Mol. Cell, 65(4):699-714).

The residues of Ubc15 E2 hA (i.e., SEQ ID NO: 2) that do not engage in direct interaction with, e.g., binding to UBA1 are: $A_1$, $A_2$, $A_4$, $A_5$, $A_6$, $A_9$, $A_{12}$, $A_{13}$, $A_{15}$, and $A_{16}$. For example, Ubc4 E2 hA residues that not engage in direct interaction with UBA1, in the context of the position numbering for SEQ ID NO:2, are: Ala-5 (i.e., $A_1$), Ser-6 (i.e., $A_2$), Gln-8 (i.e., $A_4$), Leu-9 (i.e., As), Leu-10 (i.e., $A_6$), Gln-13 (i.e., $A_9$), Glu-16 (i.e., $A_{12}$), Ile-17 (i.e., $A_{13}$), Lys-19 (i.e., $A_{15}$), and Asn-20 (i.e., $A_{16}$).

The residues of the E2 hA peptides of SEQ ID NOs:3-20 and 22-34 that are predicted to directly interact with, e.g., bind to, UBA1 are amino acid consensus positions $A_4$, $A_6$, $A_7$, $A_{10}$, and optionally $A_{13}$. For example, the UBE2A E2 hA

TABLE 1

UBA1-binding peptides from *S. pombe*. Residues that directly interact with UBA1 are in bold.

| SEQ ID NO: | Gene | Sequence |
|---|---|---|
| 1 | Ubc4 | M A L K R I N R E L A D L G K D |
| 2 | Ubc15 | M P S S A S E Q L L R K Q L K E I Q K N |

$A_{-4}$ $A_{-3}$ $A_{-2}$ $A_{-1}$ $A_1$ $A_2$ $A_3$ $A_4$ $A_5$ $A_6$ $A_7$ $A_8$ $A_8$ $A_{10}$ $A_{11}$ $A_{12}$ $A_{13}$ $A_{14}$ $A_{15}$ $A_{16}$
Consensus Amino Acid Position (SEQ ID NO:4) residues that are predicted to directly interact with UBA1, in the context of the position numbering for SEQ ID NO:4, are: Arg-7 (i.e., $A_4$), Leu-9 (i.e., $A_6$), Met-10 (i.e., $A_7$), Phe-13 (i.e., $A_{10}$), and optionally Leu-16 (i.e., $A_{13}$). In another example, the UBE2G2 E2 hA (SEQ ID NO:6) residues that are predicted to directly interact with UBA1, in the context of the position numbering for SEQ ID NO:6, are predicted to be: Lys-7 (i.e., $A_4$), Leu-9 (i.e., $A_6$), Met-10 (i.e., $A_7$), Tyr-13 (i.e., $A_{10}$), and optionally Leu-16 (i.e., $A_{13}$). In yet another example, the UBE2D2 E2 hA (SEQ ID NO:10) residues that are predicted to directly interact with UBA1, in the context of the position numbering for SEQ ID NO:10, are: Lys-4 (i.e., $A_4$), Ile-6 (i.e., $A_6$), His-7 (i.e., $A_7$), Leu-10 (i.e., $A_{10}$), and optionally Leu-13 (i.e., $A_{13}$).

The residues of the E2 hA peptides of SEQ ID NOs:3-20 and 22-34 that are predicted to not engage in direct interaction with, e.g., binding to, UBA1 are: $A_1$, $A_2$, $A_3$, $A_5$, $A_8$, $A_9$, $A_{11}$, $A_{12}$, $A_{14}$, $A_{15}$, $A_{16}$, and positions N-terminal to $A_1$. For example, UBE2A E2 hA residues that are predicted to not engage in direct interaction with UBA1, in the context of the position numbering for SEQ ID NO:4, are: Met-1 (i.e., $A_{-3}$), Ser-2 (i.e., $A_{-2}$), Thr-3 (i.e., $A_{-1}$), Pro-4 (i.e., $A_1$), Ala-5 (i.e., $A_2$), Arg-6 (i.e., $A_3$), Arg-8 (i.e., $A_5$), Arg-11 (i.e., $A_8$), Asp-12 (i.e., $A_9$), Lys-14 (i.e., $A_{11}$), Arg-15 (i.e., Gln-17 (i.e., $A_{14}$), Glu-18 (i.e., $A_{15}$), and Asp-19 (i.e., $A_{16}$). In another example, UBE2G2 E2 hA residues that are predicted to not engage in direct interaction with UBA1, in the context of the position numbering for SEQ ID NO:6, are: Met-1 (i.e., $A_{-3}$), Ala-2 (i.e., $A_{-2}$), Gly-3 (i.e., $A_4$), Thr-4 (i.e., $A_1$), Ala-5 (i.e., $A_2$), Leu-6 (i.e., $A_3$), Arg-7 (i.e., $A_5$), Ala-10 (i.e., $A_8$), Glu-11 (i.e., $A_9$), Lys-13 (i.e., $A_{11}$), Gln-14 (i.e., $A_{12}$), Thr-16 (i.e., $A_{14}$), Leu-17 (i.e., $A_{15}$), and Asn-18 (i.e., $A_{16}$). In yet another example, UBE2D2 E2 residues that are predicted to not engage in direct interaction with UBA1, in the context of the position numbering for SEQ ID NO:10, are: Met-1 (i.e., $A_1$), Ala-2 (i.e., $A_2$), Leu-3 (i.e., $A_3$), Arg-5 (i.e., As), Lys-8 (i.e., As), Glu-9 (i.e., $A_9$), Asn-11 (i.e., $A_{11}$), Asp-12 (i.e., $A_{12}$), Ala-14 (i.e., $A_{14}$), Arg-15 (i.e., $A_{15}$), and Asp-16 (i.e., $A_{16}$).

In one instance the disclosure features a peptide with the sequence BPSSASRQLLRKQLKEIQZ (SEQ ID NO: 1340), wherein B is norleucine and Z is a biotinylated lysine (Lys(biotin)). In some cases, the peptide comprises at least two (e.g., 2, 3, 4, 5) amino acid substitutions, wherein the amino acids are substituted to non-natural amino acids with olefinic side chains. In some cases, the at least two substituted amino acids are separated by 2, 3, or 6 amino acids. These peptides inhibit the E1-E2 interaction.

In one instance the disclosure features a peptide with the sequence BPSSASRQLLRKQLKEIQ (SEQ ID NO:1341), wherein B is norleucine. In some cases, the peptide comprises at least two (e.g., 2, 3, 4, 5) amino acid substitutions, wherein the amino acids are substituted to non-natural amino acids with olefinic side chains. In some cases, the at least two substituted amino acids are separated by 2, 3, or 6 amino acids. These peptides inhibit the E1-E2 interaction.

TABLE 2

UBA1-binding peptides from *H. sapiens*. Residues predicted to directly interact with UBA1 are in bold (amino acid consensus positions $A_4$, $A_6$, $A_7$, and $A_{10}$, and, optionally, $A_{13}$ for SEQ ID Nos: 3-20 and 22-34; amino acid consensus positions $A_{-1}$, $A_2$, $A_3$, $A_4$, $A_6$, $A_7$, $A_8$, $A_{10}$, $A_{11}$, and $_{A14}$ for SEQ ID NO: 21).

| SEQ ID NO: | Gene | Sequence |
|---|---|---|
| 3 | UBE2K | M A N I A V Q R I K R E F K E V L K S |
| 4 | UBE2A/UBE2B | M S T P A R R R L M R D F K R L Q E D |
| 5 | UBE2G1 | M T E L Q S A L L L R R Q L A E L N K N |
| 6 | UBE2G2 | M A G T A L K R L M A E Y K Q L T L N |
| 7 | UBE2R1 | M A R P L V P S S Q K A L L L E L K G L Q E E |
| 8 | UBE2R2 | M A Q Q Q M T S S Q K A L M L E L K S L Q E E |
| 9 | UBE2D1 | M A L K R I Q K E L S D L Q R D |
| 10 | UBE2D2 | M A L K R I H K E L N D L A R D |
| 11 | UBE2D3 | M A L K R I N K E L S D L A R D |
| 12 | UBE2D4 | M A L K R I Q K E L T D L Q R D |
| 13 | UBE2E1 | K N S K L L S T S A K R I Q K E L A D I T L D |
| 14 | UBE2E2 | K T A A K L S T S A K R I Q K E L A E I T L D |
| 15 | UBE2E3 | K T T A K L S T S A K R I Q K E L A E I T L D |
| 16 | UBE2U | M H G R A Y L L L H R D F C D L K E N N |
| 17 | UBE2J1 | M E T R Y N L K S P A V K R L M K E A A E L K D P |
| 18 | UBE2J2 | M S S T S S K R A P T T A T Q R L K Q D Y L R I K K D |
| 19 | UBE2N | M A G L P R R I I K E T Q R L L A E |
| 20 | UBE2NL | M A E L P H R I I K E T Q R L L A E |
| 21 | UBE2T | M Q R A S R L K R E L H M L A T E |
| 22 | UBE2V1 | M A A T T G S G V K V P R N F R L L E E L E E G Q K G |
| 23 | UBE2V2 | M A V S T G V K V P R N F R L L E E L E E G Q K G |

TABLE 2-continued UBA1-binding peptides from *H. sapiens*. Residues predicted to directly
interact with UBA1 are in bold (amino acid consensus positions $A_4$, $A_6$, $A_7$, and $A_{10}$,
and, optionally, $A_{13}$ for SEQ ID Nos: 3-20 and 22-34; amino acid consensus positions
$A_{-1}$, $A_2$, $A_3$, $A_4$, $A_6$, $A_7$, $A_8$, $A_{10}$, $A_{11}$, and $A_{14}$ for SEQ ID NO: 21).

| SEQ ID NO: | Gene | Sequence |
|---|---|---|
| 24 | UBE2S | M N S N V E N L P P H I I R L V Y K E V T T L T A D |
| 25 | UBE2C | A R G P V G K R L Q Q E L M T L M M S |
| 26 | UBE2W | M A S M Q K R L Q K E L L A L Q N D |
| 27 | UBE20 | A K K F F S T V R K E M A L L A T S |
| 28 | BIRC6 | A N D A N S A A R A R R L A Q E A V T L S T S |
| 29 | UBE2L3 | M A A S R R L M K E L E E I R K C |
| 30 | UBE2L6 | M M A S M R V V K E L E D L Q K K |
| 31 | FTS | G P F Y L E Y S L L A E F T L V V K Q |
| 32 | UBE2Q | G A V S G S V Q A T D R L M K E L R D I Y R S |
| 33 | UBE2Q2 | G A V S G S V Q A S D R L M K E L R D I Y R S |
| 34 | UBE2H | M S S P S P G K R R M D T V V K L I E S |

$A_{-4}$ $A_{-3}$ $A_{-2}$ $A_{-1}$ $A_1$ $A_2$ $A_3$ $A_4$ $A_5$ $A_6$ $A_7$ $A_8$ $A_8$ $A_{10}$ $A_{11}$ $A_{12}$ $A_{13}$ $A_{14}$ $A_{15}$ $A_{16}$
Consensus Amino Acid Position The residues of UBE2T E2 hA (SEQ ID NO: 21) that directly interact with, e.g., bind to, UBA1 are amino acid consensus positions $A_{-1}$, $A_2$, $A_3$, $A_4$, $A_6$, $A_7$, $A_8$, $A_{10}$, $A_{11}$, and $A_{14}$. For example, the UBE2T E2 hA residues that directly interact with UBA1, in the context of the position numbering for SEQ ID NO:21, are: Met-1 (i.e., $A_{-1}$), Arg-3 (i.e., $A_2$), Ala-4 (i.e., $A_3$), Ser-5 (i.e., $A_4$), Leu-7 (i.e., $A_6$), Lys-8 (i.e., $A_7$), Arg-9 (i.e., $A_8$), Leu-11 (i.e., $A_{10}$), His-12 (i.e., $A_{11}$), and Ala-15 (i.e., $A_{14}$) (see Lv et al., 2018, JBC, 293(47):18337-18352).

The residues of UBE2T E2 hA (SEQ ID NO: 21) that do not engage in direct interaction with, e.g., bind to, UBA1 are: $A_1$, $A_5$, $A_9$, $A_{12}$, $A_{13}$, $A_{15}$, and $A_{16}$. For example, UBE2T E2 hA residues that do not engage in direct interaction with UBA1, in the context of the position numbering for SEQ ID NO:21, are: Gln-2 (i.e., $A_1$), Arg-6 (i.e., $A_5$), Glu-10 (i.e., $A_9$), Met-13 (i.e., Leu-14 (i.e., $A_{13}$), Tyr-16 (i.e., $A_{15}$), and Glu-17 (i.e., $A_{16}$).

The disclosure also provides E2 hA peptides that bind to and inhibit the E1 UBA6. In certain embodiments, the E2 hA peptide binds to the UBA6 E1 UFD. An exemplary UBA6-binding E2 hA peptides of this disclosure is provided in Table 3 (i.e., SEQ ID NO:38). Methods for assessing a peptide's inhibition of UBA6 are known in the art and described herein.

In one instance the disclosure features a peptide with the sequence BSTPARRRLBRDFKRLQZ (SEQ ID NO:1342), wherein B is norleucine and Z is a biotinylated lysine (Lys(biotin)). In some cases, the peptide comprises at least two (e.g., 2, 3, 4, 5) amino acid substitutions, wherein the amino acids are substituted to non-natural amino acids with olefinic side chains. In some cases, the at least two substituted amino acids are separated by 2, 3, or 6 amino acids. These peptides inhibit the E1-E2 interaction.

In one instance the disclosure features a peptide with the sequence BSTPARRRLBRDFKRLQ (SEQ ID NO:1343), wherein B is norleucine. In some cases, the peptide comprises at least two (e.g., 2, 3, 4, 5) amino acid substitutions, wherein the amino acids are substituted to non-natural amino acids with olefinic side chains. In some cases, the at least two substituted amino acids are separated by 2, 3, or 6 amino acids. These peptides inhibit the E1-E2 interaction.

TABLE 3

UBA6-binding Peptide. Residues predicted to directly interact with UBA6 are in bold (amino acids Arg-5, Glu-7, Leu-8, Val-11, and Leu-14).

| SEQ ID NO: | Gene | Sequence |
|---|---|---|
| 38 | USE1 | MAASRLELNLVRLLSRC |

The residues of USE1 E2 hA (SEQ ID NO:38) that are predicted to directly interact with, e.g., bind to UBA6, in the context of the position numbering for SEQ ID NO:38, are Arg-5, Glu-7, Leu-8, Val-11, and Leu-14.

The residues of USE1 E2 hA (SEQ ID NO:38) that are predicted to not engage in direct interaction with, e.g., binding to, UBA6, in the context of the position numbering for SEQ ID NO:38, are: Met-1, Ala-2, Ala-3, Ser-4, Leu-6, Asn-9, Leu-10, Arg-12, Leu-13, Ser-15, Arg-16, and Cys-17.

The disclosure also provides E2 hA peptides that bind to and inhibit the E1 UBA3. In certain embodiments, the E2 hA peptide binds to the UBA3 E1 UFD. Exemplary human E2 hA peptides of this disclosure capable of binding to UBA3 are provided in Table 4. Methods for assessing a peptide's inhibition of UBA3 are known in the art and described herein.

TABLE 4

UBA3-binding Peptides. Residues that directly interact wiht UBA3 are in bold.

| SEQ ID NO: | Gene | Sequence |
|---|---|---|
| 35 | UBE2F | RRVSVRDKLLVKEVAE |
| 36 | UBE2M | KKASAAQLRIQKDINE |

The residues of UBE2F E2 hA (SEQ ID NO: 35) that directly interact with, e.g., bind to, UBA3, in the context of the position numbering for SEQ ID NO:35, are: Val-3, Lys-8, Val-11, Lys-12, and Val-14 (see Huang et al., 2009, Mol. Cell, 33(4):483-95).

The residues of UBE2F E2 hA (SEQ ID NO: 35) that do not engage in direct interaction with UBA3, in the context of the position numbering for SEQ ID NO:35, are: Arg-1, Arg-2, Ser-4, Val-5, Arg-6, Asp-7, Leu-9, Leu-10, Glu-13, Ala-15, and Glu-16.

The residues of UBE2M E2 hA (SEQ ID NO: 36) that directly interact with, e.g., bind to, UBA3, in the context of the position numbering for SEQ ID NO:36, are: Lys-2, Ala-3, Gln-7, Leu-8, Gln-11, Lys-12, Ile-14, Asn-15, and Glu-16 (see Huang et al., 2005, Mol. Cell, 17(3):341-350).

The residues of UBE2M E2 hA (SEQ ID NO: 36) that do not engage in direct interaction with UBA3, in the context of the position numbering for SEQ ID NO: 36, are: Lys-1, Ser-4, Ala-5, Ala-6, Arg-9, Ile-10, and Asp-13.

The disclosure also provides E2 hA peptides that bind to and inhibit UBA2. In certain embodiments, the E2 hA peptide binds to the UBA2 E1 UFD. An exemplary human E2 hA peptide of this disclosure capable of binding UBA2 is provided in Table 5 (i.e., SEQ ID NO:37). Methods for assessing a peptide's inhibition of UBA2 are known in the art and described herein.

TABLE 5

UBA2-binding Peptide. Residues that directly interact with UBA2 are in bold (amino acids Leu-2, Ser-3, Ala-6, Gln-7, Arg-9, Lys-10, Arg-13, and Lys-14).

| SEQ ID NO: | Gene | Sequence |
|---|---|---|
| 37 | UBE2I | ALSRLAQERKAWRKD |

The residues of UBE2I E2 hA (SEQ ID NO: 37) that directly interact with, e.g., bind to, UBA2, in the context of the position numbering for SEQ ID NO:37, are: Leu-2, Ser-3, Ala-6, Gln-7, Arg-9, Lys-10, Arg-13, and Lys-14 (see Wang et al., 2010, PLoS ONE, 5(12):e15805).

The residues of UBE2I E2 hA (SEQ ID NO: 37) that do not engage in direct interaction with UBA2, in the context of the position numbering for SEQ ID NO:37, are: Ala-1, Arg-4, Leu-5, Glu-8, Ala-11, Trp-12, and Asp-15.

In certain embodiments, also provided herein are peptides comprising a modified amino acid sequence of an E2 hA peptide described herein. In some cases, the peptides are modified to introduce structural stabilization to the peptide (e.g., to maintain alpha-helicity of the peptide). The structural stabilization may be by e.g., "stapling" or "stitching" the peptide. In some cases, the staple or stitch is a hydrocarbon staple or stitch. The modification(s) to introduce structural stabilization (e.g., internal cross-linking, e.g., stapling, stitching) into the E2 hA peptides described herein may be positioned on: (i) the face of the E2 hA that does not engage in direct interaction with the E2 hA's cognate E1 enzyme, (ii) the interface of the polar and nonpolar faces of the E2 hA, and/or (iii) the face of the E2 hA that directly interacts with the E2 hA's cognate E1 enzyme. In some cases, an E2 hA peptide is stabilized by introducing a staple or stitch (e.g., a hydrocarbon staple or stitch) at the interface of the polar and nonpolar faces of the E2 hA In some cases, an E2 hA peptide is stabilized by introducing a staple or stitch on the face of the E2 hA that directly interacts with the E2 hA's cognate E1 enzyme—for example, the staple may "mimic" a hydrophobic patch on the interacting face of the interacting face of the helix. In certain instances, the structurally stabilized (e.g., internally cross-linked, e.g., stapled) E2 hA peptides described herein may also contain one or more (e.g., 1, 2, 3, 4, 5, 6, 7) additional amino acid substitutions (relative to the wild type E2 hA peptide sequence), e.g., one or more (e.g., 1, 2, 3, 4, 5, 6, 7) conservative and/or non-conservative amino acid substitutions (i.e., one or more amino acid substitutions in addition to the amino acid substitutions made to the E2 hA to impart the structural stabilization). In certain instances, these additional substitution(s) are of amino acids that directly interact with the E2 hA's cognate E1 enzyme. In certain instances, these additional substitution(s) are of amino acids that do not engage in direct interaction with the E2 hA's cognate E1 enzyme. In certain instances, these additional substitutions are of both amino acids that directly interact with the E2 hA's cognate E1 enzyme and amino acids that do not engage in direct interaction with the E2 hA's cognate E1 enzyme. In certain instances, the structurally stabilized (e.g., internally cross-linked, e.g., stapled) E2 hA peptides described herein may also contain one or more (e.g., 1, 2, 3, 4, 5, 6, 7, 8, 9, 10) deletions from the N- and/or C-terminus of the E2 hA. For example, the structurally stabilized (e.g., internally cross-linked, e.g., stapled) E2 hA peptides may be 5 or more (e.g., 5, 6, 7, 8, 9, 10, 11, 12, 13, 14 15, 16, 17, 18, 19, 20, 21, 22, 23, 24, 25, 23, 27) amino acids in length. In certain instances, the structurally stabilized (e.g., internally cross-linked, e.g., stapled) E2 hA peptides are 5-11 amino acids in length. In certain instances, the structurally stabilized (e.g., internally cross-linked, e.g., stapled) E2 hA peptides are 5-17 amino acids in length. In certain instances, the structurally stabilized (e.g., internally cross-linked, e.g., stapled) E2 hA peptides are 11-17 amino acids in length. In certain instances, the structurally stabilized (e.g., internally cross-linked, e.g., stapled) E2 hA peptides are 5-27 amino acids in length. In certain instances, the structurally stabilized (e.g., internally cross-linked, e.g., stapled) E2 hA peptides are 11-27 amino acids in length. In certain instances, the structurally stabilized (e.g., internally cross-linked, e.g., stapled) E2 hA peptides are 17-27 amino acids in length.

In certain embodiments, the E2 hA peptides of this disclosure can have 1, 2, 3, 4, 5, 6, 7, 8, 9, 10, 11, 12, or 13 amino acid substitutions in any one of SEQ ID NOs:1-38 (e.g., 1, 2, 3, 4, 5, 6, 7, 8, 9, 10, 11, 12, or 13 amino acids are conservatively or non-conservatively substituted). For example, in certain embodiments, the E2 hA peptide of this disclosure comprises a modified amino acid sequence of the sequence set forth in SEQ ID NO:4, wherein the modified amino acid sequence comprises SEQ ID NO:4 having 1, 2, 3, 4, 5, 6, 7, 8, 9, 10, 11, 12, or 13 amino acid substitutions in the SEQ ID NO:4 sequence (e.g., the modified amino acid sequence comprises SEQ ID NO:4, except that 1, 2, 3, 4, 5, 6, 7, 8, 9, 10, 11, 12, or 13 amino acids of SEQ ID NO:4 are amino acids are conservatively or non-conservatively substituted). In another example, in certain embodiments, the E2 hA peptide of this disclosure comprises a modified amino acid sequence of the sequence set forth in SEQ ID NO:6, wherein the modified amino acid sequence comprises SEQ ID NO:6 having 1, 2, 3, 4, 5, 6, 7, 8, 9, 10, 11, 12, or 13 amino acid substitutions in the SEQ ID NO:6 sequence (e.g., the modified amino acid sequence comprises SEQ ID NO:6, except that 1, 2, 3, 4, 5, 6, 7, 8, 9, 10, 11, 12, or 13 amino acids of SEQ ID NO:6 are amino acids are conservatively or non-conservatively substituted). In another example, in certain embodiments, the E2 hA peptide of this disclosure comprises a modified amino acid sequence of the sequence set forth in SEQ ID NO:10, wherein the modified amino acid sequence comprises SEQ ID NO:10 having 1, 2, 3, 4, 5, 6, 7, 8, 9, 10, 11, 12, or 13 amino acid substitutions in the SEQ ID NO:10 sequence (e.g., the modified amino acid sequence comprises SEQ ID NO:10, except that 1, 2, 3, 4, 5, 6, 7, 8, 9, 10, 11, 12, or 13 amino acids of SEQ ID NO:10 are amino acids are conservatively or non-conservatively substituted). A "conservative amino acid substitution" means that the substitution replaces one amino acid with another amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). In some instances, one to three amino acids of any one of SEQ ID NOs:1-38 are substituted. The amino acid substitutions in any one of SEQ ID NOs:1-38 can be of amino acids that directly interact (or are predicted to directly interact) or do not engage in direct interaction (or are predicted to not engage in direct interaction) with the E2 hA's cognate E1 enzyme. Much greater variability is permitted in the E2 hA amino acids that do not engage in direct interaction with (or are predicted to not engage in direct interaction with) the E2 hA's cognate E1 enzyme than in the E2 hA amino acids that directly interact with (or are predicted to directly interact with) the E2 hA's cognate E1 enzyme. In fact, just about every one of the amino acids that do not engage in direct interaction with (or are predicted to not engage in direct interaction with) the E2 hA's cognate E1 enzyme can be substituted (e.g., conservative or non-conservative amino acid substitutions or substitution with alanine). In certain embodiments, 1, 2, or 3 E2 hA amino acids that directly interact with (or are predicted to directly interact with) the E2 hA's cognate E1 enzyme are substituted with another amino acid. In some instances, the substitution(s) is/are a conservative amino acid substitution. In other instances, the substitution(s) is/are a non-conservative amino acid substitution. In some instances, where there are more than one amino acid substitutions, the substitutions are both conservative and non-conservative amino acid substitutions. In some instances, where there are more than one amino acid substitutions, each of the substitutions are conservative amino acid substitutions. In some cases, where one to three amino acids (e.g., 1, 2, or 3) of any one of SEQ ID NOs:1-38 are substituted, the substitutions are all of E2 hA amino acids that do not engage in direct interaction with (or are predicted to not engage in direct interaction with) the E2 hA's cognate E1 enzyme. In some cases, where one to three amino acids (e.g., 1, 2, or 3) of any one of SEQ ID NOs:1-38 are substituted, the substitutions are all of E2 hA amino acids that directly interact with (or are predicted to directly interact with) the E2 hA's cognate E1 enzyme. In some cases, where one to three amino acids (e.g., 1, 2, or 3) of any one of SEQ ID NOs:1-38 are substituted, the substitutions are of both E2 hA amino acids that directly interact with (or are predicted to directly interact with) the E2 hA's cognate E1 enzyme and E2 hA amino acids that do not engage in direct interaction with (or are predicted to not engage in direct interaction with) the E2 hA'z cognate E1 enzyme. In certain embodiments, each of amino acid positions 8 and 11 of SEQ ID NO:132 or a stabilized version of SEQ ID NO:4, or truncated versions thereof (e.g., wherein 1, 2, 3, 4, 5, 6, 7, 8, 9, 10, 11, 12 amino acids are removed from the N- and/or C-terminus), are substituted with another amino acid. In certain embodiments, each of amino acid positions 8 and 11 of SEQ ID NO:132 or a stabilized version of SEQ ID NO:4, or truncated versions thereof (e.g., wherein 1, 2, 3, 4, 5, 6, 7, 8, 9, 10, 11, 12 amino acids are removed from the N- and/or C-terminus), are substituted with glutamic acid. In certain embodiments, each of amino acid positions 4, 6, 11, 14, and 15 of SEQ ID NO:132 or a stabilized version of SEQ ID NO:4, or truncated versions thereof (e.g., wherein 1, 2, 3, 4, 5, 6, 7, 8, 9, 10, 11, 12 amino acids are removed from the N- and/or C-terminus), are substituted with alanine. In certain embodiments, each of amino acid positions 4, 14, and 15 of SEQ ID NO: 132 or a stabilized version of SEQ ID NO:4, or truncated versions thereof (e.g., wherein 1, 2, 3, 4, 5, 6, 7, 8, 9, 10, 11, 12 amino acids are removed from the N- and/or C-terminus), are substituted with alanine and each of amino acid positions 6, 8, and 11 of SEQ ID NO: 132 or a stabilized version of SEQ ID NO:4, or truncated versions thereof (e.g., wherein 1, 2, 3, 4, 5, 6, 7, 8, 9, 10, 11, 12 amino acids are removed from the N- and/or C-terminus), are substituted with glutamic acid.

In certain instances, the substituted amino acid(s) are selected from the group consisting of L-Ala, D-Ala, Aib, Sar, Ser, a substituted alanine, or a substituted glycine derivative. In certain instances, a modified Ubc15 E2 hA peptide comprises the E7 residue (numbering according to SEQ ID NO:2) substituted with arginine.

In certain embodiments, the E2 hA peptides of this disclosure can have 1, 2, 3, 4, or 5, amino acid removed/deleted from the C-terminus of the sequence set forth in any one of SEQ ID NOs:1-38. For example, in certain embodiments, the E2 hA peptide of this disclosure comprises or consists of a modified amino acid sequence of the amino acid sequence set forth in SEQ ID NO:4, wherein two amino acids are removed/deleted from the C-terminus of the sequence of SEQ ID NO:4 (i.e., the E2 hA peptide comprises or consists of the amino acid sequence of SEQ ID NO: 39). In another example, in certain embodiments, the E2 hA peptide of this disclosure comprises or consists of a modified amino acid sequence of the amino acid sequence set forth in SEQ ID NO:6, wherein five amino acids are removed/deleted from the C-terminus of the sequence of SEQ ID NO:6 (i.e., the E2 hA peptide comprises or consists of the amino acid sequence of SEQ ID NO: 55). In certain embodiments, the E2 hA peptides of this disclosure can have 1, 2, 3, 4, or 5, amino acid removed/deleted from the N-terminus of the sequence set forth in any one of SEQ ID NOs: 1-38. In certain embodiments, the UBA1-interacting E2 hA peptides of this disclosure can have amino acid positions $A_{12}$-$A_{16}$ removed/deleted from the C-terminus of the sequence set forth in any one of SEQ ID NOs: 1-34. For example, in certain embodiments, the E2 hA peptide of this disclosure comprises or consists of a modified amino acid sequence of the amino acid sequence set forth in SEQ ID NO:6, wherein amino acid positions $A_{12}$-$A_{16}$ are removed/deleted from the C-terminus of the sequence of SEQ ID NO:6 (i.e., the E2 hA peptide comprises or consists of the amino acid sequence of SEQ ID NO: 55). In certain embodiments, the UBA1-binding E2 hA peptides of this disclosure can have 1, 2, 3, or all of the amino acid positions N-terminal to amino acid position $A_1$ removed/deleted from the N-terminus of the sequence set forth in any one of SEQ ID NOs: 1-34. In certain embodiments, the E2 hA peptides of this disclosure can have 1, 2, 3, 4, or 5, amino acid removed/deleted from both the N-terminus and C-terminus of the sequence set forth in any one of SEQ ID NOs: 1-38. In certain embodiments, the UBA1-binding E2 hA peptides of this disclosure can have 1, 2, 3, 4, or 5 amino acids removed/deleted from the C-terminus of the sequence set forth in any one of SEQ ID NOs: 1-34 and 1, 2, 3, or all of the amino acids N-terminal to amino acid position $A_1$ removed/deleted from the N-terminus of the sequence. For example, in certain embodiments, the UBA1-binding E2 hA peptide of this disclosure comprises or consists of a modified amino acid sequence of the amino acid sequence set forth in SEQ ID NO:6, wherein amino acids $A_{-3}$-$A_{-1}$ and $A_{12}$-$A_{16}$ are removed/deleted from SEQ ID NO:6 (i.e., the peptide comprises or consists of amino acids $A_1$-$A_{11}$ of SEQ ID NO:6). In another example, in certain embodiments, the UBA1-binding E2 hA peptide of this disclosure comprises or consists of a modified amino acid sequence of the amino acid sequence set forth in SEQ ID NO:6, wherein amino acids $A_{-3}$-$A_{-1}$ and $A_{12}$-$A_{16}$ are removed/deleted from SEQ ID NO:4 (i.e., the peptide comprises or consists of amino acids $A_1$-$A_{11}$ of SEQ ID NO:4). In yet another example, in certain embodiments, the UBA1-binding E2 hA peptide of this disclosure comprises or consists of a modified amino acid sequence of the amino acid sequence set forth in SEQ ID NO:6, wherein amino acids $A_{12}$-$A_{16}$ are removed/deleted from SEQ ID NO:10 (i.e., the peptide comprises or consists of amino acids $A_1$-$A_{11}$ of SEQ ID NO:10). In certain instances, these removed amino acids can be replaced with 1-6 (e.g., 1, 2, 3, 4, 5, or 6) amino acids selected from the group consisting of L-Ala, D-Ala, Aib, Sar, Ser, a substituted alanine, or a substituted glycine derivative.

The disclosure also encompasses E2 hA peptides that are at least 14% (e.g., at least 14 to 50%, at least 14 to 45%, at least 14 to 40%, at least 14 to 35%, at least 14 to 30%, at least 14 to 25%, at least 14 to 20%, at least 20% to 50%, at least 20% to 45%, at least 20% to 40%, at least 20% to 35%, at least 20% to 30%, at least 20% to 25%, at least 15%, at least 20%, at least 27%, at least 34%, at least 40% at least 45%, at least 50%, at least 55%, at least 60%, at least 65%, at least 70%, at least 75%, at least 80%, at least 85%, at least 90%, at least 95%, at least 98%, at least 99%, or 100%) identical to any one of SEQ ID NOs:1-38. The variability in amino acid sequence of any one of SEQ ID NOs:1-38 can be on one or both the directly interacting side and non-directly interacting side of the alpha helix. Just about every one of the E2 hA amino acids that do not engage in direct interaction with (or are predicted to not engage in direct interaction with) the E2 hA's cognate E1 enzyme can be varied. The E2 hA amino acids that directly interact with (or are predicted to directly interact with) the E2 hA's cognate E1 enzyme can also be varied. In specific embodiments, the E2 hA peptide comprises an amino acid sequence that is at least 90% identical to any one of SEQ ID NOs:1-38. In specific embodiments, the E2 hA peptide comprises an amino acid sequence that is at least 95%, at least 96%, at least 97%, at least 98%, at least 99% identical to any one of SEQ ID NOs:1-38. In specific embodiments, the E2 hA peptide consists of the amino acid sequence of any one of SEQ ID NOs:1-38, 99, and 55. Methods for determining percent identity between amino acid sequences are known in the art. For example, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence aligned for comparison purposes is at least 30%, preferably at least 40%, more preferably at least 50%, even more preferably at least 60%, and even more preferably at least 70%, 80%, 90%, or 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The determination of percent identity between two amino acid sequences is accomplished using the BLAST 2.0 program. Sequence comparison is performed using an ungapped alignment and using the default parameters (Blossom 62 matrix, gap existence cost of 11, per residue gapped cost of 1, and a lambda ratio of 0.85). The mathematical algorithm used in BLAST programs is described in Altschul et al. (Nucleic Acids Res. 25:3389-3402, 1997).

In some embodiments, the disclosure features variants of any one of SEQ ID NOs:1-38, wherein the peptide variants noncovalently bind to E1 (e.g., UBA1 for SEQ ID NOs:1-34, UBA6 for SEQ ID NO:38, UBA2 for SEQ ID NO:37, and UBA3 for SEQ ID NOs:35 and 36).

In certain instances, the E2 hA peptide has an amino acid sequence set forth in Table 6 below. This disclosure also features stabilized versions (e.g., internally cross-linked) of these variant E2 hA peptides. For example, two (or more) residues of these variants separated by, e.g., 3 or 6 amino acids, are replaced with non-natural amino acids that can form a cross-link by olefin methathesis. The cross-link is positioned in these variants at locations that do not disrupt binding of the E2 hA peptide to its cognate E1 enzyme. In some instances, the variant E2 hA peptides are stabilized by a hydrocarbon staple or stitch, a lactam staple or stitch; a UV-cycloaddition staple or stitch; an oxime staple or stitch; a thioether staple or stitch; a double-click staple or stitch; a bis-lactam staple or stitch; a bis-arylation staple or stitch; or a combination of any two or more thereof.

TABLE 6

Exemplary variant E2 hA peptides

| SEQ ID NO: | Sequence |
| --- | --- |
| 39 | MSTPARRRLMRDFKRLQ |
| 55 | MAGTALKRLMAEYK |
| 56 | MPSSASRQLLRKQLKEIQKN |
| 57 | MPSSASRQLLRKQLKEIQ |
| 58 | ASTPARRRLMRDFKRLQ |
| 59 | MSTPARRRLMRDFRRLQ |
| 60 | MSTPAERRLMRDFKRLQ |
| 61 | MSTPARERLMRDFKRLQ |
| 62 | MSTPARRELMRDFKRLQ |

TABLE 6-continued

Exemplary variant E2 hA peptides

| SEQ ID NO: | Sequence |
|---|---|
| 63 | MSTPARRRLMEDFKRLQ |
| 792 | MSTPARRRLMRDFKELQ |
| 793 | MATPARRRLMRDFKRLQ |
| 794 | MSAPARRRLMRDFKRLQ |
| 795 | MSTAARRRLMRDFKRLQ |
| 796 | MSTPAARRLMRDFKRLQ |
| 797 | MSTPARARLMRDFKRLQ |
| 798 | MSTPARRALMRDFKRLQ |
| 799 | MSTPARRRAMRDFKRLQ |
| 800 | MSTPARRRLARDFKRLQ |
| 801 | MSTPARRRLMADFKRLQ |
| 802 | MSTPARRRLMRDAKRLQ |
| 803 | MSTPARRRLMRDFARLQ |
| 804 | MSTPARRRLMRDFKALQ |
| 805 | MSTPARRRLMRDFKRAQ |
| 806 | MSTPARRRLMRDFKRLA |

The E2 hA peptides described herein can be optimized for therapeutic use. For example, if any of the above-described E2 hA peptides cause membrane disruption (cell lysis), the peptides can be optimized by lowering the overall peptide hydrophobicity. This can for example be achieved by substituting especially hydrophobic residues with an amino acid with lower hydrophobicity (e.g., alanine). Membrane disruption can also be lowered by reducing the overall positive charge of the peptide. This can be accomplished by substituting basic residues with uncharged or acidic residues. In certain instances, both the overall peptide hydrophobicity and the overall positive charge of the peptide are lowered.

In certain embodiments, the E2 hA peptides described herein are between 5 and 35 amino acids in length, between 5 and 25 amino acids in length, between 5 and 20 amino acids in length, between 5 and 18 amino acids in length, between 10 and 35 amino acids in length, between 10 and 25 amino acids in length, between 10 and 20 amino acids in length, between 10 and 18 amino acids in length, between 15 and 26 amino acids in length, between 15 and 18 amino acids in length, or between 10 and 28 amino acids in length. In certain embodiments, the E2 hA peptides described herein are 11, 12, 13, 14, 15, 16, 17, 18, 19, 20, 21, 22, 23, 24, 25, 26, or 27 amino acids in length.

In certain instances, the E2 hA peptides described herein are structurally stabilized. In order to stabilize these E2 hA peptides, the peptides can include two or more substitutions to replace, e.g., an amino acid of the E2 hA peptide with a non-natural amino acid, so that the peptide can be stapled and/or stitched.

Stabilized Peptides

A peptide helix is an important mediator of key protein-protein interactions that regulate many important biological processes such as apoptosis; however, when such a helix is taken out of its context within a protein and prepared in isolation, it usually adopts a random coil conformation, leading to a drastic reduction in biological activity and thus diminished therapeutic potential. The present disclosure provides structurally stabilized peptides of E2 hAs. The present disclosure includes structurally stabilized E2 hA peptides (such as those described above) comprising at least two modified amino acids joined by an internal (intramolecular) cross-link (or staple) and, in certain instances, having a reactive group ("a warhead" such as a non-natural amino acid bearing an electrophilic group) that can form a covalent bond with a cysteine (Cys) residue within a target protein to which the structurally stabilized peptide binds (e.g., an E1). Stabilized peptides as described herein include stapled peptides and stitched peptides as well as peptides containing multiple stitches, multiple staples or a mix of staples and stitches, or other chemical strategies for structural reinforcement (see. e.g., Balaram P. *Cur. Opin. Struct. Biol.* 1992; 2:845; Kemp D S, et al., *J. Am. Chem. Soc.* 1996; 118:4240; Orner B P, et al., *J. Am. Chem. Soc.* 2001; 123:5382; Chin J W, et al., *Int. Ed.* 2001; 40:3806; Chapman R N, et al., *J. Am. Chem. Soc.* 2004; 126:12252; Horne W S, et al., *Chem., Int. Ed.* 2008; 47:2853; Madden et al., *Chem Commun* (Camb). 2009 Oct. 7; (37): 5588-5590; Lau et al., *Chem. Soc. Rev.,* 2015, 44:91-102; and Gunnoo et al., *Org. Biomol. Chem.,* 2016, 14:8002-8013; all of which are incorporated by reference herein in its entirety).

In certain embodiments, one or more of the E2 hA peptides described herein can be stabilized by peptide stapling (see, e.g., Walensky, *J. Med. Chem.,* 57:6275-6288 (2014), the contents of which are incorporated by reference herein in its entirety). A peptide is "stabilized" in that it maintains its native secondary structure. For example, stapling allows a polypeptide, predisposed to have an α-helical secondary structure, to maintain its native α-helical conformation. This secondary structure increases resistance of the polypeptide to proteolytic cleavage and heat, and also may increase target binding affinity, hydrophobicity, and cell permeability. Accordingly, the stapled (cross-linked) polypeptides described herein have improved biological activity relative to a corresponding non-stapled (un-cross-linked) polypeptide.

"Peptide stapling" is a term coined from a synthetic methodology wherein two olefin-containing side-chains (e.g., cross-linkable side chains) present in a polypeptide chain are covalently joined (e.g., "stapled together") using a ring-closing metathesis (RCM) reaction to form a cross-linked ring (see, e.g., Blackwell et al., *J. Org. Chem.,* 66: 5291-5302, 2001; Angew et al., *Chem. Int. Ed.* 37:3281, 1994). As used herein, the term "peptide stapling" includes the joining of two (e.g., at least one pair of) double bond-containing side-chains, triple bond-containing side-chains, or double bond-containing and triple bond-containing side chain, which may be present in a polypeptide chain, using any number of reaction conditions and/or catalysts to facilitate such a reaction, to provide a singly "stapled" polypeptide. The term "multiply stapled" polypeptides refers to those polypeptides containing more than one individual staple, and may contain two, three, or more independent staples of various spacing. Additionally, the term "peptide stitching," as used herein, refers to multiple and tandem "stapling" events in a single polypeptide chain to provide a "stitched" (e.g., tandem or multiply stapled) polypeptide, in which two staples, for example, are linked to a common residue. Peptide stitching is disclosed, e.g., in WO 2008/121767 and WO 2010/068684, which are both hereby incorporated by reference in their entirety. In some instances, staples, as used herein, can retain the unsaturated bond or can be reduced.

In certain embodiments, one or more of the peptides described herein can be stabilized. In some instances, the E2 hA peptides of this disclosure are stabilized by a hydrocarbon staple or stitch, a lactam staple or stitch; a UV-cycloaddition staple or stitch; an oxime staple or stitch; a thioether staple or stitch; a double-click staple or stitch; a bis-lactam staple or stitch; a bis-arylation staple or stitch; or a combination of any two or more thereof. In one instance, the peptides described herein are stabilized by hydrocarbon stapling. In some embodiments, the stapled peptide is a cross-linked version of a polypeptide comprising or consisting of any one of the amino acids sequences of SEQ ID NOs:1-39, 55-63, or 792-806. In some instances, the stapled peptide is a hydrocarbon stapled version of a polypeptide comprising or consisting of any one of the amino acids sequences of SEQ ID NOs:1-39, 55-63, or 792-806. In some instances, the stapled peptide is a polypeptide comprising or consisting of any one of the amino acids sequences of SEQ ID NOs:1-39, 55-63, or 792-806, except that at least two (e.g., 2, 3, 4, 5, 6) amino acids of SEQ ID NOs:1-39, 55-63, or 792-806 are replaced with a non-natural amino acid (e.g., S5, R8). In some embodiments, the stapled peptide is a polypeptide comprising or consisting of any one of the amino acids sequences of SEQ ID NOs:1-38 or comprising 1 to 13 (e.g., 1, 2, 3, 4, 5, 6, 7, 8, 9, 10, 11, 12, or 13) amino acid substitutions, deletions and/or insertions therein (e.g., as described above and in the Examples below, e.g., SEQ ID NO:39, 55, or 47). In certain instances, the stapled peptide includes at least two (e.g., 2, 3, 4, 5, 6) amino acid substitutions, wherein the substituted amino acids are separated by two, three, or six amino acids, and wherein the substituted amino acids are non-natural amino acids with olefinic side chains. There are many known non-natural or unnatural amino acids any of which may be included in the peptides of the present disclosure. Some examples of unnatural amino acids are 4-hydroxyproline, desmosine, gamma-aminobutyric acid, beta-cyanoalanine, norvaline, 4-(E)-butenyl-4(R)-methyl-N-methyl-L-threonine, N-methyl-L-leucine, 1-amino-cyclopropanecarboxylic acid, 1-amino-2-phenyl-cyclopropanecarboxylic acid, 1-amino-cyclobutanecarboxylic acid, 4-amino-cyclopentenecarboxylic acid, 3-amino-cyclohexanecarboxylic acid, 4-piperidylacetic acid, 4-amino-1-methylpyrrole-2-carboxylic acid, 2,4-diaminobutyric acid, 2,3-diaminopropionic acid, 2,4-diaminobutyric acid, 2-aminoheptanedioic acid, 4-(aminomethyl)benzoic acid, 4-aminobenzoic acid, ortho-, meta- and/para-substituted phenylalanines (e.g., substituted with —C(=O)C$_6$H$_5$; —CF$_3$; —CN; -halo; —NO$_2$; CH$_3$), disubstituted phenylalanines, substituted tyrosines (e.g., further substituted with —C=O)C$_6$H$_5$; —CF$_3$; —CN; -halo; —NO$_2$; CH$_3$), and statine. Additionally, amino acids can be derivatized to include amino acid residues that are hydroxylated, phosphorylated, sulfonated, acylated, or glycosylated.

Hydrocarbon stapled polypeptides include one or more tethers (linkages) between two non-natural amino acids, which tether significantly enhances the α-helical secondary structure of the polypeptide. Generally, the tether extends across the length of one or two helical turns (i.e., about 3.4 or about 7 amino acids). Accordingly, amino acids positioned at i and i+3; i and i+4; or i and i+7 are ideal candidates for chemical modification and cross-linking. Thus, for example, where a peptide has the sequence . . . X1, X2, X3, X4, X5, X6, X7, X8, X9 . . . , cross-links between X1 and X4, or between X1 and X5, or between X1 and X8 are useful hydrocarbon stapled forms of that peptide, as are cross-links between X2 and X5, or between X2 and X6, or between X2 and X9, etc. The use of multiple cross-links (e.g., 2, 3, 4, or more) is also contemplated. The use of multiple cross-links is very effective at stabilizing and optimizing the peptide, especially with increasing peptide length. Thus, the disclosure encompasses the incorporation of more than one cross-link within the polypeptide sequence to either further stabilize the sequence or facilitate the structural stabilization, proteolytic resistance, acid stability, thermal stability, cellular permeability, and/or biological activity enhancement of longer polypeptide stretches. Additional description regarding making and use of hydrocarbon stapled polypeptides can be found, e.g., in U.S. Patent Publication Nos. 2012/0172285, 2010/0286057, and 2005/0250680, the contents of all of which are incorporated by reference herein in their entireties.

In certain embodiments when a staple is at the i and i+3 residues, R-propenylalanine and S-pentenylalanine; or R-pentenylalanine and S-pentenylalanine are substituted for the amino acids at those positions. In certain embodiments when a staple is at the i and i+4 residues, S-pentenyl alanine is substituted for the amino acids at those positions. In certain embodiments when a staple is at the i and i+7 residues, S-pentenyl alanine and R-octenyl alanine are substituted for the amino acids at those positions. In some instances, when the peptide is stitched, the amino acids of the peptide to be involved in the "stitch" are substituted with Bis-pentenylglycine, S-pentenylalanine, and R-octenylalanine; or Bis-pentenylglycine, S-octenylalanine, and R-octenylalanine.

In a peptide to be stapled, amino acids that interfere with (e.g., inhibit or reduce the efficiency of) the stapling reaction should be substituted with amino acids that do not interfere with (e.g., do not inhibit or do not substantially reduce the efficiency of) the stapling reaction. For example, methionine (Met, M) may interfere with the stapling reaction; thus, in certain embodiments, the methionine(s) in a peptide to be stapled is replaced with, e.g., norleucine(s).

In certain embodiments in which the peptide is a UBA1-binding E2 hA (e.g., any one of SEQ ID NOs:1-34 or a modified version thereof (e.g., SEQ ID NO:39, 55, or 57)), the staple and/or stitch is made at positions $A_2$ and $A_9$, $A_5$ and $A_9$, $A_8$ and $A_{12}$, $A_9$ and $A_{13}$, $A_1$ and $A_8$, $A_4$ and $A_{11}$, or As and $A_{12}$. In certain embodiments in which the peptide is a UBA1-binding E2 hA (e.g., any one of SEQ ID NOs:1-34 or a modified version thereof (e.g., SEQ ID NO:39, 55, or 57, or a modified version thereof)), the staple and/or stitch is made at positions $A_2$ and $A_9$ (see Table 7 for exemplary stapled peptides). In certain embodiments in which the peptide is a UBA1-binding E2 hA (e.g., any one of SEQ ID NOs:1-34 or a modified version thereof (e.g., SEQ ID NO:39, 55, or 57, or a modified version thereof)), the staple and/or stitch is made at positions $A_1$ and $A_8$. Staple positions can be varied by testing different staple locations in a staple walk.

In certain embodiments in which the peptide comprises or consists of SEQ ID NO:35 or a modified version thereof, the staple and/or stitch is made at positions Arg-6 and Glu-13. In certain embodiments in which the peptide comprises or consists of SEQ ID NO:36 or a modified version thereof, the staple and/or stitch is made at positions Ala-6 and Asp-13. In certain embodiments in which the peptide comprises or consists of SEQ ID NO:37 or a modified version thereof, the staple and/or stitch is made at positions Leu-5 and Trp-12. In certain embodiments in which the peptide comprises or consists of SEQ ID NO:38 or a modified version thereof, the staple and/or stitch is made at positions Ala-3 and Leu-10. See Tables 7 and 8 for exemplary stapled peptides.

TABLE 7

Exemplary stapled peptides. SEQ ID NOs: 64-99 and 850 (from top to bottom, respectively): "B" is norleucine, "$X_1$" and "$X_2$" are non-natural amino acids which can be covalently joined ("stapled together") using aring-closing metathesis (RCM) reaction to form across-linked ring. SEQ ID NOs: 100-135 and 851 (from top to bottom, respectively): "B" is norleucine, "$X_1$" is R-octenyl alanine, and "$X_2$" is S-pentenyl alanine.
"tr" = truncated; "m" = mutant

| SEQ ID NO: | Gene | Sequence |
|---|---|---|
| 64, 100 | UBE2K | B A N I $X_1$ V Q R I K R $X_2$ F K E V L K S |
| 65, 101 | UBE2A/UBE2B | B S T P $X_1$ R R R L B R $X_2$ F K R L Q E D |
| 66, 102 | UBE2G1 | B T E L Q $X_1$ A L L L R R $X_2$ L A E L N K N |
| 67, 103 | UBE2G2 | B A G T $X_1$ L K R L B A $X_2$ Y K Q L T L N |
| 68, 104 | UBE2R1 | B A R P L V P S $X_1$ Q K A L L L $X_2$ L K G L Q E E |
| 69, 105 | UBE2R2 | B A Q Q Q B T S $X_1$ Q K A L B L $X_2$ L K S L Q E E |
| 70, 106 | UBE2D1 | B $X_1$ L K R I Q K K $X_2$ L S D L Q R D |
| 71, 107 | UBE2D2 | B $X_1$ L K R I H K K $X_2$ L N D L A R D |
| 72, 108 | UBE2D3 | B $X_1$ L K R I N K K $X_2$ L S D L A R D |
| 73, 109 | UBE2D4 | B $X_1$ L K R I Q K K $X_2$ L T D L Q R D |
| 74, 110 | UBE2E1 | K N S K L L S T $X_1$ A K R I Q K K $X_2$ L A D I T L D |
| 75, 111 | UBE2E2 | K T A A K L S T $X_1$ A K R I Q K K $X_2$ L A E I T L D |
| 76, 112 | UBE2E3 | K T T A K L S T $X_1$ A K R I Q K K $X_2$ L A E I T L D |
| 77, 113 | UBE2U | B H G R A $X_1$ L L L H R D $X_2$ C D L K E N N |
| 78, 114 | UBE2J1 | B E T R Y N L K S P $X_1$ V K R L B K $X_2$ A A E L K D P |
| 79, 115 | UBE2J2 | B S S T S S K R A P T T $X_1$ T Q R L K Q $X_2$ Y L R I K K D |
| 80, 116 | UBE2N | B A G $X_1$ P R R I I K $X_2$ T Q R L L A E |
| 81, 117 | UBE2NL | B A E $X_1$ P H R I I K $X_2$ T Q R L L A E |
| 82, 118 | UBE2T | B Q $X_1$ A S R L K R $X_2$ L H B L A T E |
| 83, 119 | UBE2V1 | B A A T T G S G V K V P $X_1$ N F R L L E $X_2$ L E E G Q K G |
| 84, 120 | UBE2V2 | B A V S T G V K V P $X_1$ N F R L L E $X_2$ L E E G Q K G |
| 85, 121 | UBE2S | B N S N V E N L P P H $X_1$ I R L V Y K $X_2$ V T T L T A D |
| 86, 122 | UBE2C | A R G P $X_1$ G K R L Q Q $X_2$ L B T L B B S |
| 87, 123 | UBE2W | B A S $X_1$ Q K R L Q K $X_2$ L L A L Q N D |
| 88, 124 | UBE2O | A K K $X_1$ F S T V R K $X_2$ B A L L A T S |
| 89, 125 | BIRC6 | A N D A N S A A $X_1$ A R R L A Q $X_2$ A V T L S T S |
| 90, 126 | UBE2L3 | B A $X_1$ S R R L B K $X_2$ L E E I R K C |
| 91, 127 | UBE2L6 | B B $X_1$ S B R V V K $X_2$ L E D L Q K K |
| 92, 128 | FTS | G P F Y $X_1$ E Y S L L A $X_2$ F T L V V K Q |
| 93, 129 | UBE2Q | G A V S G S V Q $X_1$ T D R L B K $X_2$ L R D I Y R S |
| 94, 130 | UBE2Q2 | G A V S G S V Q $X_1$ S D R L B K $X_2$ L R D I Y R S |
| 95, 131 | UBE2H | B S S P S P $X_1$ K R R B D T $X_2$ V V K L I E S |

TABLE 7-continued

Exemplary stapled peptides. SEQ ID NOs: 64-99 and 850 (from top to bottom, respectively): "B" is norleucine, "$X_1$" and "$X_2$" are non-natural amino acids which can be covalently joined ("stapled together") using a ring-closing metathesis (RCM) reaction to form a cross-linked ring. SEQ ID NOs: 100-135 and 851 (from top to bottom, respectively): "B" is norleucine, "$X_1$" is R-octenyl alanine, and "$X_2$" is S-pentenyl alanine. "tr" = truncated; "m" = mutant

| SEQ ID NO: | Gene | Sequence |
|---|---|---|
| 96, 132 | UBE2A-tr/UBE2B-tr | B S T P $X_1$ R R R L B R $X_2$ F K R L Q |
| 97, 133 | UBE2G2-tr | B A G T $X_1$ L K R L B A $X_2$ Y K |
| 98, 134 | Ubc4 | B $X_1$ L K R I N R $X_2$ L A D L G K D |
| 99, 135 | Ubc15 | B P S S A $X_1$ E Q L L R K $X_2$ L K E I Q K N |
| 850, 851 | Ubc15-tr-m | B P S S A $X_1$ R Q L L R K $X_2$ L K E I Q |
| | | $A_{-4}$ $A_{-3}$ $A_{-2}$ $A_{-1}$ $A_1$ $A_2$ $A_3$ $A_4$ $A_5$ $A_6$ $A_7$ $A_8$ $A_8$ $A_{10}$ $A_{11}$ $A_{12}$ $A_{13}$ $A_{14}$ $A_{15}$ $A_{16}$ Consensus Amino Acid Position |

Table 8. Exemplary stapled peptides. SEQ ID NOs:136-139 (from top to bottom, respectively): "B" is norleucine, "$X_1$" and "$X_2$" are non-natural amino acids which can be covalently joined ("stapled together") using a ring-closing metathesis (RCM) reaction to form a cross-linked ring. SEQ ID NOs:140-143 (from top to bottom, respectively): "B" is norleucine, "$X_1$" is R-octenyl alanine, and "$X_2$" is S-pentenyl alanine.

| SEQ ID NOS: | Gene | Sequence |
|---|---|---|
| 136, 140 | UBE2F | RRVSV$X_1$DKLLVK$X_2$VAE |
| 137, 141 | UBE2M | KKASA$X_1$QLRIQK$X_2$INE |
| 138, 142 | UBE2I | ALSR$X_1$AQERKA$X_2$RKD |
| 139, 143 | USE1 | BA$X_1$SRLELN$X_2$VRLLSRC |

Figure 26:
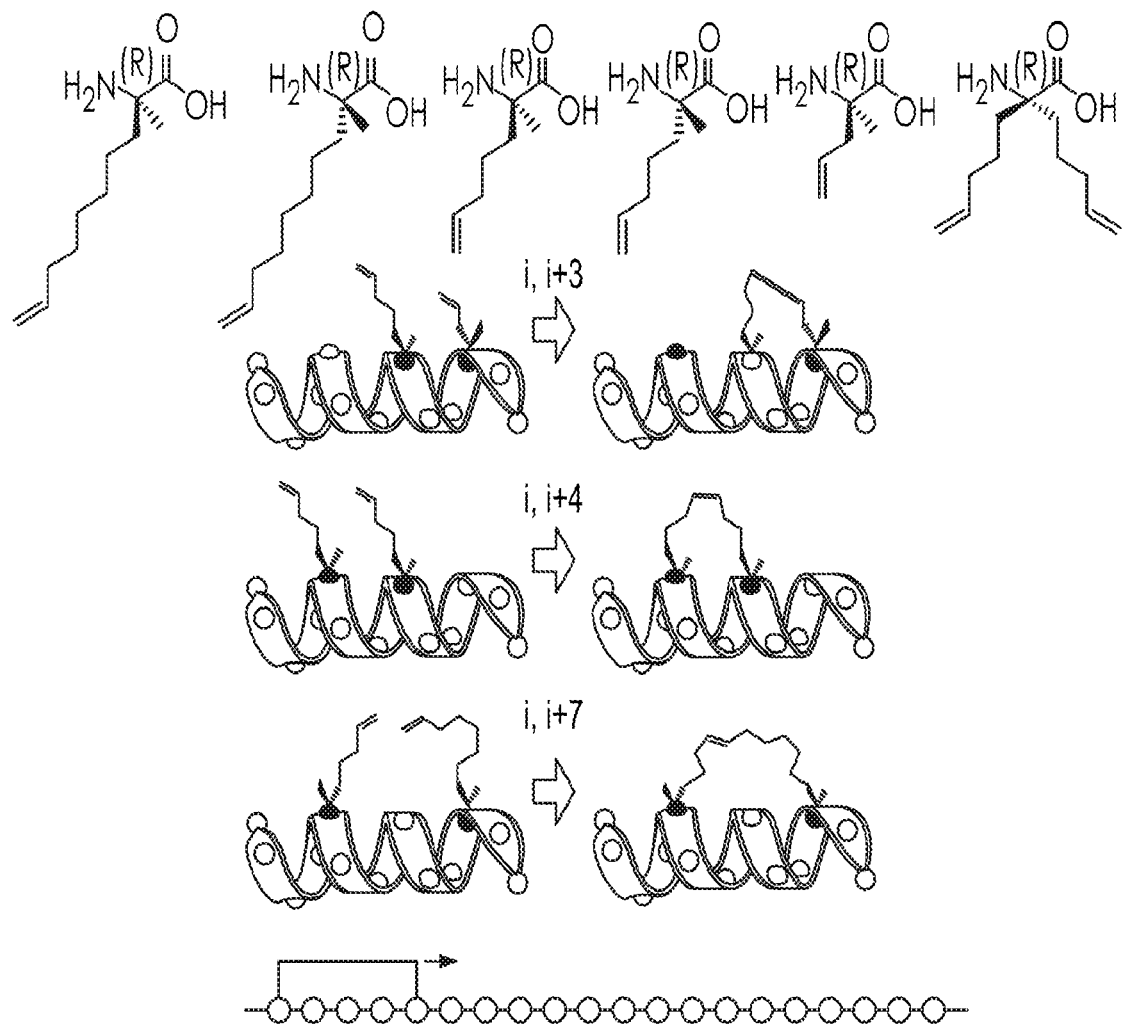
FIG. 26 shows the chemical structures of exemplary unnatural amino acids used to generate various kinds of staples (top). The middle panel illustrates peptides with staples of various lengths. The bottom panel illustrates a staple walk along a peptide sequence.
Figure 27:
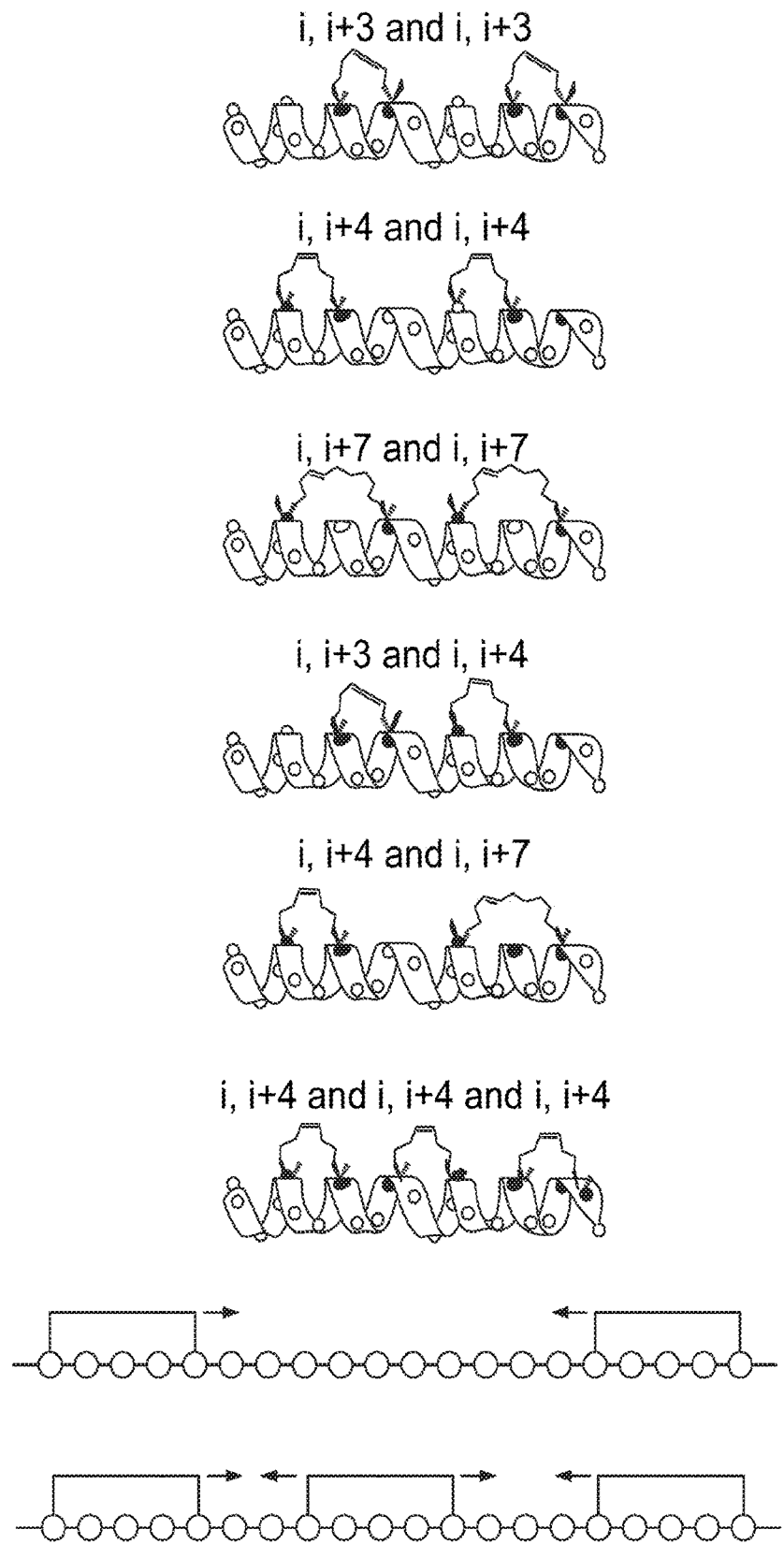
FIG. 27 is a schematic showing representations of various kinds of double and triple stapling strategies along with exemplary staple walks.
Figure 28:
FIG. 28 is a schematic showing exemplary staple walks using various lengths of branched double staple or "stitched" moieties.
Figure 29:
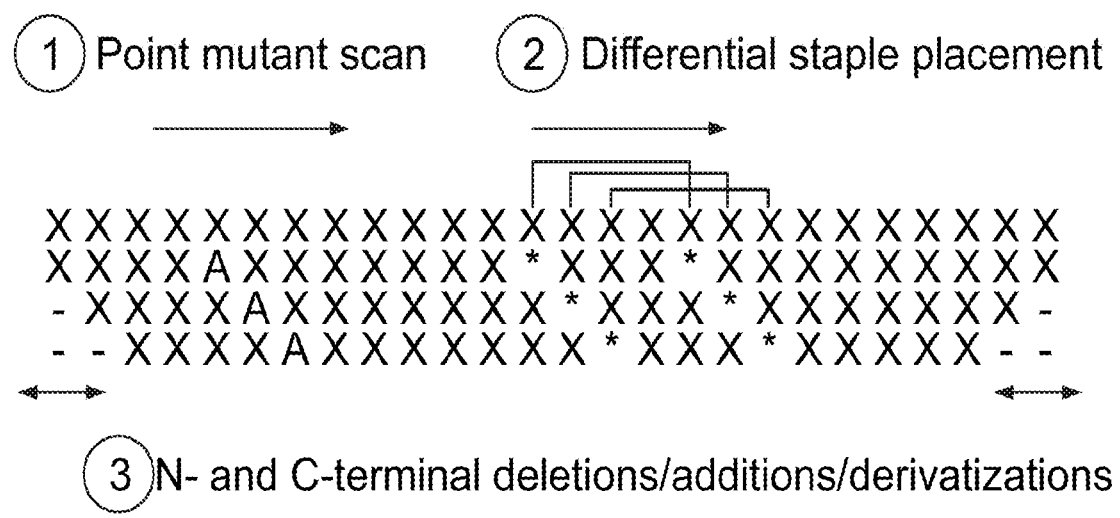
FIG. 29 is a schematic showing exemplary chemical alterations that are employed to generate stapled peptide derivatives.

FIG. 26 top panel shows exemplary chemical structures of non-natural amino acids that can be used to generate various crosslinked compounds. FIG. 26 middle panel illustrates peptides with hydrocarbon cross-links between positions i and i+3; i and i+4; and i and i+7 residues. FIG. 26 bottom panel illustrates a staple walk along a peptide sequence. FIG. 27 shows various peptide sequences with double and triple stapling strategies, and exemplary staple walks. FIG. 28 illustrates exemplary staple walks using various lengths of branched stitched moieties. FIG. 29 illustrates peptide variants based on point mutant and staple scans, and N- and C-terminal deletions, additions, and/or derivatizations.

In one aspect, a stabilized E2 hA peptide has the formula (I),

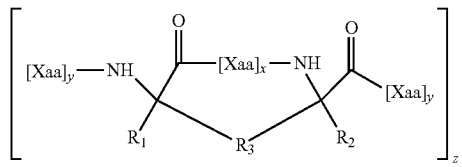

wherein:

each $R_1$ and $R_2$ are independently H or a $C_1$ to $C_{10}$ alkyl, alkenyl, alkynyl, arylalkyl, cycloalkylalkyl, heteroarylalkyl, or heterocyclylalkyl;

$R_3$ is alkyl, alkenyl, alkynyl; $[R_4—K—R_4]_n$; each of which is substituted with 0-6 $R_5$;

$R_4$ is alkyl, alkenyl, or alkynyl;

$R_5$ is halo, alkyl, $OR_6$, $N(R_6)_2$, $SR_6$, $SOR_6$, $SO_2R_6$, $CO_2R_6$, $R_6$, a fluorescent moiety, or a radioisotope;

K is O, S, SO, $SO_2$, CO, $CO_2$, $CONR_6$, or

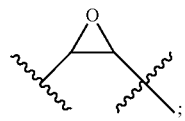 [SMILES: *C1OC1*]

$R_6$ is H, alkyl, or a therapeutic agent;

n is an integer from 1-4;

x is an integer from 2-10;

each y is independently an integer from 0-100;

z is an integer from 1-10 (e.g., 1, 2, 3, 4, 5, 6, 7, 8, 9, 10);

and each Xaa is independently an amino acid. In some embodiments, each of the N-terminal $[Xaa]_y$ of formula (I), the $[Xaa]_x$ of formula (I), and the C-terminal $[Xaa]_y$ of formula (I) is as described for any one of constructs 1-225 of Table 9. For example, for a stabilized peptide comprising the N-terminal $[Xaa]_y$, the $[Xaa]_x$, and the C-terminal $[Xaa]_y$ of construct 7 of Table 9, the N-terminal $[Xaa]_y$, the $[Xaa]_x$, and the C-terminal $[Xaa]_y$ may be: (i) SEQ ID NO:871, SEQ ID NO:872, and SEQ ID NO:873, respectively, (ii) P, SEQ ID NO:872, and SEQ ID NO:873, respectively, (iii) P, SEQ ID NO:872, and FK, respectively, or (iv) SEQ ID NO:871, SEQ ID NO:872, and FK, respectively.

TABLE 9

N-terminal [Xaa]$_y$, [Xaa]$_x$, and C-terminal [Xaa]$_y$ sequences for formula (I) constructs 1-225.

| Construct | [Xaa]$_y$ N-terminal | [Xaa]$_x$ | [Xaa]$_y$ C-terminal |
|---|---|---|---|
| 1 | MANI (SEQ ID NO: 855) or I | VQRIKR (SEQ ID NO: 856) | FK or FKEVLKS (SEQ ID NO: 857) |
| 2 | MANIAVQ (SEQ ID NO: 858) or IAVQ (SEQ ID NO: 859) | IKR | FK or FKEVLKS (SEQ ID NO: 857) |
| 3 | MANIAVQRIK (SEQ ID NO: 861) or IAVQRIK (SEQ ID NO: 862) | EFK | VLKS (SEQ ID NO: 863) or absent |
| 4 | MANIAVQRIKR (SEQ ID NO: 864) or IAVQRIKR (SEQ ID NO: 865) | FKE | LKS or absent |
| 5 | MAN or absent | AVQRIK (SEQ ID NO: 866) | EFK or EFKEVLKS (SEQ ID NO: 867) |
| 6 | MANIAV (SEQ ID NO: 868) or IAV | RIKREF (SEQ ID NO: 869) | EVLKS (SEQ ID NO: 870) or absent |
| 7 | MSTP (SEQ ID NO: 871) or P | RRRLMR (SEQ ID NO: 872) | FKRLQED (SEQ ID NO: 873) or FK |
| 8 | MSTPARR (SEQ ID NO: 874) or PARR (SEQ ID NO: 875) | LMR | FKRLQED (SEQ ID NO: 873) or FK |
| 9 | MSTPARRRLM (SEQ ID NO: 876) or PARRRLM (SEQ ID NO: 877) | DFK | LQED (SEQ ID NO: 878) or absent |
| 10 | MSTPARRRLMR (SEQ ID NO: 879) or PARRRLMR (SEQ ID NO: 880) | FKR | QED or absent |
| 11 | MST or absent | ARRRLM (SEQ ID NO: 881) | DFKRLQED (SEQ ID NO: 882) or DFK |
| 12 | MSTPAR (SEQ ID NO: 883) or PAR | RLMRDF (SEQ ID NO: 884) | RLQED (SEQ ID NO: 885) or absent |
| 13 | MTEL (SEQ ID NO: 886) or L | SALLLR (SEQ ID NO: 887) | QL or QLAELNKN (SEQ ID NO: 889) |
| 14 | MTELQSA (SEQ ID NO: 890) or LQSA (SEQ ID NO: 891) | LLR | QL or QLAELNKN (SEQ ID NO: 889) |
| 15 | MTELQSALLL (SEQ ID NO: 892) or LQSALLL (SEQ ID NO: 893) | RQL | ELNKN (SEQ ID NO: 894) or absent |
| 16 | MTELQSALLLR (SEQ ID NO: 895) or LQSALLLR (SEQ ID NO: 896) | QLA | LNKN (SEQ ID NO: 860) or absent |
| 17 | MTE or absent | QSALLL (SEQ ID NO: 897) | RQLAELNKN (SEQ ID NO: 898) or RQL |
| 18 | MTELQS (SEQ ID NO: 900) or LQS | LLLRRQ (SEQ ID NO: 901) | AELNKN (SEQ ID NO: 902) or absent |
| 19 | MAGT (SEQ ID NO: 903) or T | LKRLMA (SEQ ID NO: 905) | YKQLTLN (SEQ ID NO: 906) or YK |
| 20 | MAGTALK (SEQ ID NO: 907) or TALK (SEQ ID NO: 908) | LMA | YKQLTLN (SEQ ID NO: 906) or YK |
| 21 | MAGTALKRLM (SEQ ID NO: 909) or TALKRLM (SEQ ID NO: 910) | EYK | LTLN (SEQ ID NO: 911) or absent |

TABLE 9-continued

N-terminal [Xaa]$_y$, [Xaa]$_x$, and C-terminal [Xaa]$_y$ sequences for formula (I) constructs 1-225.

| Construct | [Xaa]$_y$ N-terminal | [Xaa]$_x$ | [Xaa]$_y$ C-terminal |
|---|---|---|---|
| 22 | MAGTALKRLMA (SEQ ID NO: 912) or TALKRLMA (SEQ ID NO: 913) | YKQ | TLN or absent |
| 23 | MAG or absent | ALKRLM (SEQ ID NO: 914) | EYKQLTLN (SEQ ID NO: 915) or EYK |
| 24 | MAGTAL (SEQ ID NO: 916) or TAL | RLMAEY (SEQ ID NO: 917) | QLTLN (SEQ ID NO: 918) or absent |
| 25 | MARPLVPS (SEQ ID NO: 919) or S | QKALLL (SEQ ID NO: 928) | LKGLQEE (SEQ ID NO: 931) or LK |
| 26 | MARPLVPSSQK (SEQ ID NO: 920) or SSQK (SEQ ID NO: 921) | LLL | LKGLQEE (SEQ ID NO: 931) or LK |
| 27 | MARPLVPSSQKALL (SEQ ID NO: 922) or SSQKALL (SEQ ID NO: 923) | ELK | LQEE (SEQ ID NO: 932) or absent |
| 28 | MARPLVPSSQKALLL (SEQ ID NO: 924) or SSQKALLL (SEQ ID NO: 925) | LKG | QEE or absent |
| 29 | MARPLVP (SEQ ID NO: 926) or absent | SQKALL (SEQ ID NO: 929) | ELKGLQEE (SEQ ID NO: 933) or ELK |
| 30 | MAQQQMTS (SEQ ID NO: 935) or S | QKALML (SEQ ID NO: 944) | LKSLQEE (SEQ ID NO: 947) or LK |
| 31 | MAQQQMTSSQK (SEQ ID NO: 936) or SSQK (SEQ ID NO: 937) | LML | LKSLQEE (SEQ ID NO: 947) or LK |
| 32 | MAQQQMTSSQKALM (SEQ ID NO: 938) or SSQKALM (SEQ ID NO: 939) | ELK | LQEE (SEQ ID NO: 932) or absent |
| 33 | MAQQQMTSSQKALML (SEQ ID NO: 940) or SSQKALML (SEQ ID NO: 941) | LKS | QEE or absent |
| 34 | MAQQQMT (SEQ ID NO: 942) or absent | SQKALM (SEQ ID NO: 945) | ELKSLQEE (SEQ ID NO: 949) or ELK |
| 35 | M | LKRIQK (SEQ ID NO: 954) | LSDLQRD (SEQ ID NO: 957) or LS |
| 36 | MALK (SEQ ID NO: 951) | IQK | LSDLQRD (SEQ ID NO: 957) or LS |
| 37 | MALKRIQ (SEQ ID NO: 952) | ELS | LQRD (SEQ ID NO: 958) or absent |
| 38 | MALKRIQK (SEQ ID NO: 953) | LSD | QRD or absent |
| 39 | Absent | ALKRIQ (SEQ ID NO: 955) | ELSDLQRD (SEQ ID NO: 959) or ELS |
| 40 | MAL | RIQKEL (SEQ ID NO: 956) | DLQRD (SEQ ID NO: 960) or absent |
| 41 | M | LKRIHK (SEQ ID NO: 964) | LNDLARD (SEQ ID NO: 967) or LN |
| 42 | MALK (SEQ ID NO: 951) | IHK | LNDLARD (SEQ ID NO: 967) or LN |
| 43 | MALKRIH (SEQ ID NO: 962) | ELN | LARD (SEQ ID NO: 968) or absent |

TABLE 9-continued

N-terminal [Xaa]_y, [Xaa]_x, and C-terminal [Xaa]_y sequences for formula (I) constructs 1-225.

| Construct | [Xaa]_y N-terminal | [Xaa]_x | [Xaa]_y C-terminal |
|---|---|---|---|
| 44 | MALKRIHK (SEQ ID NO: 963) | LND | ARD or absent |
| 45 | absent | ALKRIH (SEQ ID NO: 965) | ELNDLARD (SEQ ID NO: 969) or ELN |
| 46 | MAL | RIHKEL (SEQ ID NO: 966) | DLARD (SEQ ID NO: 970) or absent |
| 47 | M | LKRINK (SEQ ID NO: 974) | LSDLARD (SEQ ID NO: 977) or LS |
| 48 | MALK (SEQ ID NO: 951) | INK | LSDLARD (SEQ ID NO: 977) or LS |
| 49 | MALKRIN (SEQ ID NO: 972) | ELS | LARD (SEQ ID NO: 978) or absent |
| 50 | MALKRINK (SEQ ID NO: 973) | LSD | ARD or absent |
| 51 | absent | ALKRIN (SEQ ID NO: 975) | ELSDLARD (SEQ ID NO: 979) or ELS |
| 52 | MAL | RINKEL (SEQ ID NO: 976) | DLARD (SEQ ID NO: 980) or absent |
| 53 | M | LKRIQK (SEQ ID NO: 954) | LTDLQRD (SEQ ID NO: 987) or LT |
| 54 | MALK (SEQ ID NO: 951) | IQK | LTDLQRD (SEQ ID NO: 987) or LT |
| 55 | MALKRIQ (SEQ ID NO: 952) | ELT | LQRD (SEQ ID NO: 958) or absent |
| 56 | MALKRIQK (SEQ ID NO: 953) | LTD | QRD or absent |
| 57 | Absent | ALKRIQ (SEQ ID NO: 955) | ELTDLQRD (SEQ ID NO: 989) or ELT |
| 58 | MAL | RIQKEL (SEQ ID NO: 956) | DLQRD (SEQ ID NO: 960) or absent |
| 59 | KNSKLLST (SEQ ID NO: 991) or T | AKRIQK (SEQ ID NO: 1000) | LADITLD (SEQ ID NO: 1003) or LA |
| 60 | KNSKLLSTSAK (SEQ ID NO: 992) or TSAK (SEQ ID NO: 993) | IQK | LADITLD (SEQ ID NO: 1003) or LA |
| 61 | KNSKLLSTSAKRIQ (SEQ ID NO: 994) or TSAKRIQ (SEQ ID NO: 995) | ELA | ITLD (SEQ ID NO: 1004) or absent |
| 62 | KNSKLLSTSAKRIQK (SEQ ID NO: 996) or TSAKRIQK (SEQ ID NO: 997) | LAD | TLD or absent |
| 63 | KNSKLLS (SEQ ID NO: 998) or absent | SAKRIQ (SEQ ID NO: 1001) | ELADITLD (SEQ ID NO: 1005) or ELA |
| 64 | KNSKLLSTSA (SEQ ID NO: 999) or TSA | RIQKEL (SEQ ID NO: 956) | DITLD (SEQ ID NO: 1006) or absent |
| 65 | KTAAKLST (SEQ ID NO: 1007) or T | AKRIQK (SEQ ID NO: 1000) | LAEITLD (SEQ ID NO: 1019) or LA |
| 66 | KTAAKLSTSAK (SEQ ID NO: 1008) or TSAK (SEQ ID NO: 993) | IQK | LAEITLD (SEQ ID NO: 1019) LA |

TABLE 9-continued

N-terminal [Xaa]$_y$, [Xaa]$_x$, and C-terminal [Xaa]$_y$ sequences for formula (I) constructs 1-225.

| Construct | [Xaa]$_y$ N-terminal | [Xaa]$_x$ | [Xaa]$_y$ C-terminal |
|---|---|---|---|
| 67 | KTAAKLSTSAKRIQ (SEQ ID NO: 1010) or TSAKRIQ (SEQ ID NO: 995) | ELA | ITLD (SEQ ID NO: 1004) or absent |
| 68 | KTAAKLSTSAKRIQK (SEQ ID NO: 1012) or TSAKRIQK (SEQ ID NO: 997) | LAE | TLD or absent |
| 69 | KTAAKLS (SEQ ID NO: 1014) or absent | SAKRIQ (SEQ ID NO: 1001) | ELAEITLD (SEQ ID NO: 1021) or ELA |
| 70 | KTAAKLSTSA (SEQ ID NO: 1015) or TSA | RIQKEL (SEQ ID NO: 956) | EITLD (SEQ ID NO: 1022) or absent |
| 71 | KTTAKLST (SEQ ID NO: 1023) or T | AKRIQK (SEQ ID NO: 1000) | LAEITLD (SEQ ID NO: 1019) or LA |
| 72 | KTTAKLSTSAK (SEQ ID NO: 1024) or TSAK (SEQ ID NO: 993) | IQK | LAEITLD (SEQ ID NO: 1019) or LA |
| 73 | KTTAKLSTSAKRIQ (SEQ ID NO: 1026) or TSAKRIQ (SEQ ID NO: 995) | ELA | ITLD (SEQ ID NO: 1004) or absent |
| 74 | KTTAKLSTSAKRIQK (SEQ ID NO: 1028) or TSAKRIQK (SEQ ID NO: 997) | LAE | TLD or absent |
| 75 | KTTAKLS (SEQ ID NO: 1030) or absent | SAKRIQ (SEQ ID NO: 1001) | ELAEITLD (SEQ ID NO: 1021) or ELA |
| 76 | KTTAKLSTSA (SEQ ID NO: 1031) or TSA | RIQKEL (SEQ ID NO: 956) | EITLD (SEQ ID NO: 1022) or absent |
| 77 | MHGRA (SEQ ID NO: 1039) or A | LLLHRD (SEQ ID NO: 1047) | CDLKENN (SEQ ID NO: 1050) or CD |
| 78 | MHGRAYLL (SEQ ID NO: 1040) or AYLL (SEQ ID NO: 948) | HRD | CDLKENN (SEQ ID NO: 1050) or CD |
| 79 | MHGRAYLLLHR (SEQ ID NO: 1041) or AYLLLHR (SEQ ID NO: 1042) | FCD | KENN (SEQ ID NO: 1051) or absent |
| 80 | MHGRAYLLLHRD (SEQ ID NO: 1043) or AYLLLHRD (SEQ ID NO: 1044) | CDL | ENN or absent |
| 81 | MHGR (SEQ ID NO: 1045) or absent | YLLLHR (SEQ ID NO: 1048) | FCDLKENN (SEQ ID NO: 1052) or FCD |
| 82 | MHGRAYL (SEQ ID NO: 1046) or AYL | LHRDFC (SEQ ID NO: 1049) | LKENN (SEQ ID NO: 1053) or absent |
| 83 | METRYNLKSP (SEQ ID NO: 1054) or P | VKRLMK (SEQ ID NO: 1063) | AAELKDP (SEQ ID NO: 1068) or AA |
| 84 | METRYNLKSPAVK (SEQ ID NO: 1055) or PAVK (SEQ ID NO: 1056) | LMK | AAELKDP (SEQ ID NO: 1068) or AA |
| 85 | METRYNLKSPAVKRLM (SEQ ID NO: 1057) or PAVKRLM (SEQ ID NO: 1058) | EAA | LKDP (SEQ ID NO: 1069) or absent |
| 86 | METRYNLKSPAVKRLMK (SEQ ID NO: 1059) or PAVKRLMK (SEQ ID NO: 1060) | AAE | KDP or absent |

TABLE 9-continued

N-terminal [Xaa]$_y$, [Xaa]$_x$, and C-terminal [Xaa]$_y$ sequences for formula (I) constructs 1-225.

| Construct | [Xaa]$_y$ N-terminal | [Xaa]$_x$ | [Xaa]$_y$ C-terminal |
|---|---|---|---|
| 87 | METRYNLKS (SEQ ID NO: 1061) or absent | AVKRLM (SEQ ID NO: 1064) | EAAELKDP (SEQ ID NO: 1070) or EAA |
| 88 | METRYNLKSPAV (SEQ ID NO: 1062) or PAV | RLMKEA (SEQ ID NO: 1067) | ELKDP (SEQ ID NO: 1071) or absent |
| 89 | MSSTSSKRAPTT (SEQ ID NO: 1072) or T | TQRLKQ (SEQ ID NO: 1081) | YLRIKKD (SEQ ID NO: 1084) or YL |
| 90 | MSSTSSKRAPTTATQ (SEQ ID NO: 1073) or TATQ (SEQ ID NO: 1074) | LKQ | YLRIKKD (SEQ ID NO: 1084) or YL |
| 91 | MSSTSSKRAPTTATQRLK (SEQ ID NO: 1075) or TATQRLK (SEQ ID NO: 1076) | DYL | IKKD (SEQ ID NO: 1085) or absent |
| 92 | MSSTSSKRAPTTATQRLKQ (SEQ ID NO: 1077) or TATQRLKQ (SEQ ID NO: 1078) | YLR | KKD or absent |
| 93 | MSSTSSKRAPT (SEQ ID NO: 1079) or absent | ATQRLK (SEQ ID NO: 1082) | DYLRIKKD (SEQ ID NO: 1086) or DYL |
| 94 | MSSTSSKRAPTTAT (SEQ ID NO: 1080) or TAT | RLKQDY (SEQ ID NO: 1083) | RIKKD (SEQ ID NO: 1087) or absent |
| 95 | MAG or G | PRRIIKE (SEQ ID NO: 1095) | TQRLLAE (SEQ ID NO: 1098) or TQ |
| 96 | MAGLPR (SEQ ID NO: 1088) or GLPR (SEQ ID NO: 1089) | IIK | TQRLLAE (SEQ ID NO: 1098) or TQ |
| 97 | MAGLPRRII (SEQ ID NO: 1090) or GLPRRII (SEQ ID NO: 1091) | ETQ | LLAE (SEQ ID NO: 1099) or absent |
| 98 | MAGLPRRIIK (SEQ ID NO: 1092) GLPRRIIK (SEQ ID NO: 1093) | TQR | LAE or absent |
| 99 | MA or absent | LPRRII (SEQ ID NO: 1096) | ETQRLLAE (SEQ ID NO: 1100) or ETQ |
| 100 | MAGLP (SEQ ID NO: 1094) or GLP | RIIKET (SEQ ID NO: 1097) | RLLAE (SEQ ID NO: 1101) or absent |
| 101 | MAE or E | PHRIIK (SEQ ID NO: 1109) | TQRLLAE (SEQ ID NO: 1098) or TQ |
| 102 | MAELPH (SEQ ID NO: 1102) or ELPH (SEQ ID NO: 1103) | IIK | TQRLLAE (SEQ ID NO: 1098) or TQ |
| 103 | MAELPHRII (SEQ ID NO: 1104) or ELPHRII (SEQ ID NO: 1105) | ETQ | LLAE (SEQ ID NO: 1099) or absent |
| 104 | MAELPHRIIK (SEQ ID NO: 1106) or ELPHRIIK (SEQ ID NO: 1107) | TQR | LAE or absent |
| 105 | MA or absent | LPHRII (SEQ ID NO: 1110) | ETQRLLAE (SEQ ID NO: 1100) or ETQ |
| 106 | MAELP (SEQ ID NO: 1108) or ELP | RIIKETQ (SEQ ID NO: 1111) | RLLAE (SEQ ID NO: 1101) or absent |
| 107 | MQ or Q | ASRLKR (SEQ ID NO: 1123) | LHMLATE (SEQ ID NO: 1126) or LH |
| 108 | MQRAS (SEQ ID NO: 1116) or QRAS (SEQ ID NO: 1117) | LKR | LHMLATE (SEQ ID NO: 1126) or LH |

TABLE 9-continued

N-terminal [Xaa]$_y$, [Xaa]$_x$, and C-terminal [Xaa]$_y$ sequences for formula (I) constructs 1-225.

| Construct | [Xaa]$_y$ N-terminal | [Xaa]$_x$ | [Xaa]$_y$ C-terminal |
|---|---|---|---|
| 109 | MQRASRLK (SEQ ID NO: 1118) or QRASRLK (SEQ ID NO: 1119) | ELH | LATE (SEQ ID NO: 1127) or absent |
| 110 | MQRASRLKR (SEQ ID NO: 1120) or QRASRLKR (SEQ ID NO: 1121) | LHM | ATE or absent |
| 111 | M or absent | RASRLK (SEQ ID NO: 1124) | ELHMLATE (SEQ ID NO: 1128) or ELH |
| 112 | MQRA (SEQ ID NO: 1122) or QRA | RLKREL (SEQ ID NO: 1125) | MLATE (SEQ ID NO: 1129) or absent |
| 113 | MAATTGSGVKVP (SEQ ID NO: 1130) or P | NFRLLE (SEQ ID NO: 1139) | LEEGQKG (SEQ ID NO: 1143) or LE |
| 114 | MAATTGSGVKVPRNF (SEQ ID NO: 1131) or PRNF (SEQ ID NO: 1132) | LLE | LEEGQKG (SEQ ID NO: 1143) or LE |
| 115 | MAATTGSGVKVPRNFRLL (SEQ ID NO: 1133) or PRNFRLL (SEQ ID NO: 1134) | ELE | GQKG (SEQ ID NO: 1144) or absent |
| 116 | MAATTGSGVKVPRNFRLLE (SEQ ID NO: 1135) or PRNFRLLE (SEQ ID NO: 1136) | LEEG (SEQ ID NO: 1140) | QKG or absent |
| 117 | MAATTGSGVKV (SEQ ID NO: 1137) or absent | RNFRLL (SEQ ID NO: 1141) | ELEEGQKG (SEQ ID NO: 1145) or ELE |
| 118 | MAATTGSGVKVPRN (SEQ ID NO: 1138) or PRN | RLLEEL (SEQ ID NO: 1142) | EGQKG (SEQ ID NO: 1146) or absent |
| 119 | MAVSTGVKVP (SEQ ID NO: 1147) or P | NFRLLE (SEQ ID NO: 1139) | LEEGQKG (SEQ ID NO: 1143) or LE |
| 120 | MAVSTGVKVPRNF (SEQ ID NO: 1148) or PRNF (SEQ ID NO: 1132) | LLE | LEEGQKG (SEQ ID NO: 1143) or LE |
| 121 | MAVSTGVKVPRNFRLL (SEQ ID NO: 1150) or PRNFRLL (SEQ ID NO: 1134) | ELE | GQKG (SEQ ID NO: 1144) or absent |
| 122 | MAVSTGVKVPRNFRLLE (SEQ ID NO: 1152) or PRNFRLLE (SEQ ID NO: 1136) | LEE | QKG or absent |
| 123 | MAVSTGVKV (SEQ ID NO: 1154) or absent | RNFRLL (SEQ ID NO: 1141) | ELEEGQKG (SEQ ID NO: 1145) or ELE |
| 124 | MAVSTGVKVPRN (SEQ ID NO: 1155) or PRN | RLLEEL (SEQ ID NO: 1142) | EGQKG (SEQ ID NO: 1146) or absent |
| 125 | MNSNVENLPPH (SEQ ID NO: 1163) or H | IRLVYK (SEQ ID NO: 1172) | VTTLTAD (SEQ ID NO: 1175) or VT |
| 126 | MNSNVENLPPHIIR (SEQ ID NO: 1164) or HIIR (SEQ ID NO: 1165) | VYK | VTTLTAD (SEQ ID NO: 1175) or VT |
| 127 | MNSNVENLPPHIIRLVY (SEQ ID NO: 1166) or HIIRLVY (SEQ ID NO: 1167) | EVT | LTAD (SEQ ID NO: 1176) or absent |
| 128 | MNSNVENLPPHIIRLVYK (SEQ ID NO: 1168) or HIIRLVYK (SEQ ID NO: 1169) | VTT | TAD or absent |

TABLE 9-continued

N-terminal [Xaa]_y, [Xaa]_x, and C-terminal [Xaa]_y sequences for formula (I) constructs 1-225.

| Construct | [Xaa]_y N-terminal | [Xaa]_x | [Xaa]_y C-terminal |
|---|---|---|---|
| 129 | MNSNVENLPP (SEQ ID NO: 1170) or absent | IIRLVY (SEQ ID NO: 1173) | EVTTLTAD (SEQ ID NO: 1177) or EVT |
| 130 | MNSNVENLPPHII (SEQ ID NO: 1171) or HII | LVYKEV (SEQ ID NO: 1174) | TLTAD (SEQ ID NO: 1178) or absent |
| 131 | ARGP (SEQ ID NO: 1179) or P | GKRLQQ (SEQ ID NO: 1187) | LMTLMMS (SEQ ID NO: 1190) or LM |
| 132 | ARGPVGK (SEQ ID NO: 1180) or PVGK (SEQ ID NO: 1181) | LQQ | LMTLMMS (SEQ ID NO: 1190) or LM |
| 133 | ARGPVGKRLQ (SEQ ID NO: 1182) or PVGKRLQ (SEQ ID NO: 1183) | ELM | LMMS (SEQ ID NO: 1191) or absent |
| 134 | ARGPVGKRLQQ (SEQ ID NO: 1184) or PVGKRLQQ (SEQ ID NO: 1185) | LMT | MMS or absent |
| 135 | ARG or absent | VGKRLQ (SEQ ID NO: 1188) | ELMTLMMS (SEQ ID NO: 1192) or ELM |
| 136 | ARGPVG (SEQ ID NO: 1186) or PVG | RLQQEL (SEQ ID NO: 1189) | TLMMS (SEQ ID NO: 1319) or absent |
| 137 | MAS or S | QKRLQK (SEQ ID NO: 1201) | LLALQND (SEQ ID NO: 1204) or LL |
| 138 | MASMQK (SEQ ID NO: 1194) or SMQK (SEQ ID NO: 1195) | LQK | LLALQND (SEQ ID NO: 1204) or LL |
| 139 | MASMQKRLQ (SEQ ID NO: 1196) or SMQKRLQ (SEQ ID NO: 1197) | ELL | LQND (SEQ ID NO: 1205) or absent |
| 140 | MASMQKRLQK (SEQ ID NO: 1198) or SMQKRLQK (SEQ ID NO: 1199) | LLA | QND or absent |
| 141 | MA or absent | MQKRLQ (SEQ ID NO: 1202) | ELLALQND (SEQ ID NO: 1206) or ELL |
| 142 | MASMQ (SEQ ID NO: 1200) or SMQ | RLQKELL (SEQ ID NO: 1203) | ALQND (SEQ ID NO: 1207) or absent |
| 143 | AKK or K | FSTVRK (SEQ ID NO: 1215) | MALLATS (SEQ ID NO: 1218) or MA |
| 144 | AKKFFS (SEQ ID NO: 1208) or KFFS (SEQ ID NO: 1209) | VRK | MALLATS (SEQ ID NO: 1218) or MA |
| 145 | AKKFFSTVR (SEQ ID NO: 1210) or KFFSTVR (SEQ ID NO: 1211) | EMA | LATS (SEQ ID NO: 1219) or absent |
| 146 | AKKFFSTVRK (SEQ ID NO: 1212) or KFFSTVRK (SEQ ID NO: 1213) | MAL | ATS or absent |
| 147 | AK or absent | FFSTVR (SEQ ID NO: 1216) | EMALLATS (SEQ ID NO: 1220) or EMA |
| 148 | AKKFF (SEQ ID NO: 1214) or KFF | TVRKEMA (SEQ ID NO: 1217) | LLATS (SEQ ID NO: 1221) or absent |
| 149 | ANDANSAA (SEQ ID NO: 1222) or A | ARRLAQ (SEQ ID NO: 1231) | AVTLSTS (SEQ ID NO: 1234) or AV |

TABLE 9-continued

N-terminal [Xaa]$_y$, [Xaa]$_x$, and C-terminal [Xaa]$_y$ sequences for formula (I) constructs 1-225.

| Construct | [Xaa]$_y$ N-terminal | [Xaa]$_x$ | [Xaa]$_y$ C-terminal |
|---|---|---|---|
| 150 | ANDANSAARAR (SEQ ID NO: 1223) or ARAR (SEQ ID NO: 1224) | LAQ | AVTLSTS (SEQ ID NO: 1234) or AV |
| 151 | ANDANSAARARRLA (SEQ ID NO: 1225) or ARARRLA (SEQ ID NO: 1226) | EAV | LSTS (SEQ ID NO: 1235) or absent |
| 152 | ANDANSAARARRLAQ (SEQ ID NO: 1227) or ARARRLAQ (SEQ ID NO: 1228) | AVT | STS or absent |
| 153 | ANDANSA (SEQ ID NO: 1229) or absent | RARRLA (SEQ ID NO: 1232) | EAVTLSTS (SEQ ID NO: 1236) or EAV |
| 154 | ANDANSAARA (SEQ ID NO: 1230) or ARA | RLAQEA (SEQ ID NO: 1233) | TLSTS (SEQ ID NO: 1237) or absent |
| 155 | MA or A | SRRLMK (SEQ ID NO: 1245) | LEEIRKC (SEQ ID NO: 1248) or LE |
| 156 | MAASR (SEQ ID NO: 1238) or AASR (SEQ ID NO: 1239) | LMK | LEEIRKC (SEQ ID NO: 1248) or LE |
| 157 | MAASRRLM (SEQ ID NO: 1240) or AASRRLM (SEQ ID NO: 1241) | ELE | IRKC (SEQ ID NO: 1249) or absent |
| 158 | MAASRRLMK (SEQ ID NO: 1242) or AASRRLMK (SEQ ID NO: 1243) | LEE | RKC or absent |
| 159 | M or absent | ASRRLM (SEQ ID NO: 1246) | ELEEIRKC (SEQ ID NO: 1250) or ELE |
| 160 | MAAS (SEQ ID NO: 1244) or AAS | RLMKEL (SEQ ID NO: 1247) | EIRKC (SEQ ID NO: 1251) or absent |
| 161 | MM or M | SMRVVK (SEQ ID NO: 1259) | LEDLQKK (SEQ ID NO: 1262) or LE |
| 162 | MMASM (SEQ ID NO: 1252) or MASM (SEQ ID NO: 1253) | VVK | LEDLQKK (SEQ ID NO: 1262) or LE |
| 163 | MMASMRVV (SEQ ID NO: 1254) or MASMRVV (SEQ ID NO: 1255) | ELE | LQKK (SEQ ID NO: 1263) or absent |
| 164 | MMASMRVVK (SEQ ID NO: 1256) or MASMRVVK (SEQ ID NO: 1257) | LED | QKK or absent |
| 165 | M or absent | ASMRVV (SEQ ID NO: 1260) | ELEDLQKK (SEQ ID NO: 1264) or ELE |
| 166 | MMAS (SEQ ID NO: 1258) or MAS | RVVKEL (SEQ ID NO: 1261) | DLQKK (SEQ ID NO: 1265) or absent |
| 167 | GPFY (SEQ ID NO: 1266) or Y | EYSLLA (SEQ ID NO: 1274) | FTLVVKQ (SEQ ID NO: 1277) or FT |
| 168 | GPFYLEY (SEQ ID NO: 1267) or YLEY (SEQ ID NO: 1268) | LLA | FTLVVKQ (SEQ ID NO: 1277) or FT |
| 169 | GPFYLEYSLL (SEQ ID NO: 1269) or YLEYSLL (SEQ ID NO: 1270) | EFT | VVKQ (SEQ ID NO: 1278) or absent |
| 170 | GPFYLEYSLLA (SEQ ID NO: 1271) or YLEYSLLA (SEQ ID NO: 1272) | FTL | VKQ or absent |

TABLE 9-continued

N-terminal [Xaa]$_y$, [Xaa]$_x$, and C-terminal [Xaa]$_y$ sequences for formula (I) constructs 1-225.

| Construct | [Xaa]$_y$ N-terminal | [Xaa]$_x$ | [Xaa]$_y$ C-terminal |
|---|---|---|---|
| 171 | GPF or absent | LEYSLL (SEQ ID NO: 1275) | EFTLVVKQ (SEQ ID NO: 1279) or EFT |
| 172 | GPFYLE (SEQ ID NO: 1273) or YLE | SLLAEF (SEQ ID NO: 1276) | LVVKQ (SEQ ID NO: 1280) or absent |
| 173 | GAVSGSVQ (SEQ ID NO: 1281) or Q | TDRLMK (SEQ ID NO: 1291) | LRDIYRS (SEQ ID NO: 1294) or LR |
| 174 | GAVSGSVQATD (SEQ ID NO: 1282) or QATD (SEQ ID NO: 1283) | LMK | LRDIYRS (SEQ ID NO: 1294) or LR |
| 175 | GAVSGSVQATDRLM (SEQ ID NO: 1284) or QATDRLM (SEQ ID NO: 1285) | ELR | IYRS (SEQ ID NO: 1295) or absent |
| 176 | GAVSGSVQATDRLMK (SEQ ID NO: 1286) or QATDRLMK (SEQ ID NO: 1314) | LRD | YRS or absent |
| 177 | GAVSGSV (SEQ ID NO: 1313) or absent | ATDRLM (SEQ ID NO: 1312) | ELRDIYRS (SEQ ID NO: 1311) or ELR |
| 178 | GAVSGSVQAT (SEQ ID NO: 1309) or GQAT (SEQ ID NO: 1305) | RLMKEL (SEQ ID NO: 1247) | DIYRS (SEQ ID NO: 1310) or absent |
| 179 | GAVSGSVQ (SEQ ID NO: 1281) or Q | SDRLMK (SEQ ID NO: 1320) | LRDIYRS (SEQ ID NO: 1294) or LR |
| 180 | GAVSGSVQASD (SEQ ID NO: 1193) or QASD (SEQ ID NO: 1162) | LMK | LRDIYRS (SEQ ID NO: 1294) or LR |
| 181 | GAVSGSVQASDRLM (SEQ ID NO: 1161) or QASDRLM (SEQ ID NO: 1160) | ELR | IYRS (SEQ ID NO: 1295) or absent |
| 182 | GAVSGSVQASDRLMK (SEQ ID NO: 1159) or QASDRLMK (SEQ ID NO: 1158) | LRD | YRS or absent |
| 183 | GAVSGSV (SEQ ID NO: 1288) or absent | ASDRLM (SEQ ID NO: 1157) | ELRDIYRS (SEQ ID NO: 1296) or ELR |
| 184 | GAVSGSVQAS (SEQ ID NO: 1156) or QAS | RLMKEL (SEQ ID NO: 1247) | DIYRS (SEQ ID NO: 1297) or absent |
| 185 | MAASR (SEQ ID NO: 1238) | ELNLVR (SEQ ID NO: 1153) | LSRC (SEQ ID NO: 1151) |
| 186 | RRVSV (SEQ ID NO: 1149) | DKLLVK (SEQ ID NO: 1115) | VAE |
| 187 | KKASAA (SEQ ID NO: 1114) | LRIQKD (SEQ ID NO: 1113) | NE |
| 188 | ALSR (SEQ ID NO: 1112) | AQERKA (SEQ ID NO: 1038) | RKD |
| 189 | MPSSA (SEQ ID NO: 1037) or A | EQLLRK (SEQ ID NO: 1036) | LKEIQKN (SEQ ID NO: 1035), LKEIQ (SEQ ID NO: 1034), or QLK |
| 190 | MPSSASEQ (SEQ ID NO: 1033), MPSSASRQ (SEQ ID NO: 1032), ASEQ (SEQ ID NO: 1029), or ASRQ (SEQ ID NO: 1027) | LRK | LKEIQKN (SEQ ID NO: 1025), LKEIQ (SEQ ID NO: 1020), or QLK |

TABLE 9-continued

N-terminal [Xaa]$_y$, [Xaa]$_x$, and C-terminal [Xaa]$_y$ sequences for formula (I) constructs 1-225.

| Construct | [Xaa]$_y$ N-terminal | [Xaa]$_x$ | [Xaa]$_y$ C-terminal |
|---|---|---|---|
| 191 | MPSSASEQLLR (SEQ ID NO: 1018), MPSSASRQLLR (SEQ ID NO: 1017), ASEQLLR (SEQ ID NO: 1016), ASRQLLR (SEQ ID NO: 1013) | QLK | IQKN (SEQ ID NO: 1011) or IQ |
| 192 | MPSSASEQLLRK (SEQ ID NO: 1009) or MPSSASRQLLRK (SEQ ID NO: 1002), ASEQLLRK (SEQ ID NO: 990), or ASRQLLRK (SEQ ID NO: 988) | LKE | QKN or Q |
| 193 | MPSS (SEQ ID NO: 986) or absent | SEQLLR (SEQ ID NO: 985) | QLKEIQKN (SEQ ID NO: 984), QLKEIQ (SEQ ID NO: 983), or QLK |
| 194 | MPSSASE (SEQ ID NO: 982), MPSSASR (SEQ ID NO: 981), or ASR | LLRKQL (SEQ ID NO: 971) | EIQKN (SEQ ID NO: 961) or EIQ |
| 195 | MANIAVQ (SEQ ID NO: 858) IAVQ (SEQ ID NO: 859) | IKREFK (SEQ ID NO: 888) | VLKS (SEQ ID NO: 863) or absent |
| 196 | MSTPARR (SEQ ID NO: 874) or PARR (SEQ ID NO: 875) | LMRDFK (SEQ ID NO: 899) | LQED (SEQ ID NO: 878) or absent |
| 197 | MTELQSA (SEQ ID NO: 890) or LQSA (SEQ ID NO: 891) | LLRRQL (SEQ ID NO: 904) | ELNKN (SEQ ID NO: 894) or LQ or absent |
| 198 | MAGTALK (SEQ ID NO: 907) or TALK (SEQ ID NO: 908) | LMAEYK (SEQ ID NO: 927) | LTLN (SEQ ID NO: 911) or absent |
| 199 | MARPLVPSSQK (SEQ ID NO: 920) or SSQK (SEQ ID NO: 921) | LLLELK (SEQ ID NO: 930) | LQEE (SEQ ID NO: 932) or absent |
| 200 | MAQQQMTSSQK (SEQ ID NO: 936) or SSQK (SEQ ID NO: 937) | LMLELK (SEQ ID NO: 934) | LQEE (SEQ ID NO: 932) or absent |
| 201 | MALK (SEQ ID NO: 951) | IQKELS (SEQ ID NO: 943) | LQRD (SEQ ID NO: 958) or absent |
| 202 | MALK (SEQ ID NO: 951) | IHKELN (SEQ ID NO: 946) | LARD (SEQ ID NO: 968) or absent |
| 203 | MALK (SEQ ID NO: 951) | INKELS (SEQ ID NO: 950) | LARD (SEQ ID NO: 968) or absent |
| 204 | MALK (SEQ ID NO: 951) | IQKELT (SEQ ID NO: 1065) | LQRD (SEQ ID NO: 958) or absent |
| 205 | KNSKLLSTSAK (SEQ ID NO: 992) or TSAK (SEQ ID NO: 993) | IQKELA (SEQ ID NO: 1066) | ITLD (SEQ ID NO: 1004) or absent |
| 206 | KTAAKLSTSAK (SEQ ID NO: 1008) or TSAK (SEQ ID NO: 1315) | IQKELA (SEQ ID NO: 1066) | ITLD (SEQ ID NO: 1020) or absent |
| 207 | KTTAKLSTSAK (SEQ ID NO: 1024) or TSAK (SEQ ID NO: 1317) | IQKELA (SEQ ID NO: 1066) | ITLD (SEQ ID NO: 1036) or absent |

TABLE 9-continued

N-terminal [Xaa]_y, [Xaa]_x, and C-terminal [Xaa]_y sequences for formula (I) constructs 1-225.

| Construct | [Xaa]_y N-terminal | [Xaa]_x | [Xaa]_y C-terminal |
|---|---|---|---|
| 208 | MHGRAYLL (SEQ ID NO: 1040) or AYLL (SEQ ID NO: 948) | HRDFCD (SEQ ID NO: 1287) | KENN (SEQ ID NO: 1051) or absent |
| 209 | METRYNLKSPAVK (SEQ ID NO: 1055) or PAVK (SEQ ID NO: 1056) | LMKEAA (SEQ ID NO: 1289) | LKDP (SEQ ID NO: 1069) or absent |
| 210 | MSSTSSKRAPTTATQ (SEQ ID NO: 1073) or TATQ (SEQ ID NO: 1074) | LKQDYL (SEQ ID NO: 1290) | IKKD (SEQ ID NO: 1085) or absent |
| 211 | MAGLPR (SEQ ID NO: 1088) or GLPR (SEQ ID NO: 1089) | IIKETQ (SEQ ID NO: 1292) | LLAE (SEQ ID NO: 1099) or absent |
| 212 | MAELPH (SEQ ID NO: 1102) or ELPH (SEQ ID NO: 1103) | IIKETQ (SEQ ID NO: 1292) | LLAE (SEQ ID NO: 1099) or absent |
| 213 | MQRAS (SEQ ID NO: 1116) or QRAS (SEQ ID NO: 1117) | LKRELH (SEQ ID NO: 1293) | LATE (SEQ ID NO: 1127) or absent |
| 214 | MAATTGSGVKVPRNF (SEQ ID NO: 1131) or PRNF (SEQ ID NO: 1132) | LLEELE (SEQ ID NO: 1298) | GQKG (SEQ ID NO: 1144) or absent |
| 215 | MAVSTGVKVPRNF (SEQ ID NO: 1148) or PRNF (SEQ ID NO: 1132) | LLEELE (SEQ ID NO: 1298!) | GQKG (SEQ ID NO: 1144) or absent |
| 216 | MNSNVENLPPHIIR (SEQ ID NO: 1164) or HIIR (SEQ ID NO: 1165) | VYKEVT (SEQ ID NO: 1299) | LTAD (SEQ ID NO: 1176) or absent |
| 217 | ARGPVGK (SEQ ID NO: 1180) or PVGK (SEQ ID NO: 1181) | LQQELM (SEQ ID NO: 1300) | LMMS (SEQ ID NO: 1191) or absent |
| 218 | MASMQK (SEQ ID NO: 1194) or SMQK (SEQ ID NO: 1195) | LQKELL (SEQ ID NO: 1301) | LQND (SEQ ID NO: 1205) or absent |
| 219 | AKKFFS (SEQ ID NO: 1208) or KFFS (SEQ ID NO: 1209) | VRKEMA (SEQ ID NO: 1302) | LATS (SEQ ID NO: 1219) or absent |
| 220 | ANDANSAARAR (SEQ ID NO: 1223) or ARAR (SEQ ID NO: 1224) | LAQEAV (SEQ ID NO: 1303) | LSTS (SEQ ID NO: 1235) or absent |
| 221 | MAASR (SEQ ID NO: 1238) or AASR (SEQ ID NO: 1239) | LMKELE (SEQ ID NO: 1304) | IRKC (SEQ ID NO: 1249) or absent |
| 222 | MMASM (SEQ ID NO: 1252) or MASM (SEQ ID NO: 1253) | VVKELE (SEQ ID NO: 1306) | LQKK (SEQ ID NO: 1263) or absent |
| 223 | GPFYLEY (SEQ ID NO: 1267) or YLEY (SEQ ID NO: 1268) | LLAEFT (SEQ ID NO: 1307) | VVKQ (SEQ ID NO: 1278) or absent |
| 224 | GAVSGSVQATD (SEQ ID NO: 1282) or QATD (SEQ ID NO: 1283) | LMKELR (SEQ ID NO: 1308) | IYRS (SEQ ID NO: 1295) or absent |
| 225 | GAVSGSVQASD (SEQ ID NO: 1193) or QASD (SEQ ID NO: 1162) | LMKELR (SEQ ID NO: 1308) | IYRS (SEQ ID NO: 1295) or absent |

In certain instances, methionine (M) in the sequences set forth above in Table 9 is replaced with norleucine (B). In certain instances, the sequences set forth above in Table 9 can have at least one (e.g., 1, 2, 3, 4, 5, 6) amino acid substitution or deletion. The E2 hA peptides can include any amino acid sequence described herein.

The tether can include an alkyl, alkenyl, or alkynyl moiety (e.g., $C_5$, $C_8$, or $C_{11}$ alkyl, a $C_5$, $C_8$, or $C_{11}$ alkenyl, or $C_5$, $C_8$, or $C_{11}$ alkynyl). The tethered amino acid can be alpha disubstituted (e.g., $C_1$-$C_3$ or methyl).

In some instances, x is 2, 3, or 6. In some instances, each y is independently an integer between 0 and 15, or 3 and 15. In some instances, $R_1$ and $R_2$ are each independently H or $C_1$-$C_6$ alkyl. In some instances, $R_1$ and $R_2$ are each independently $C_1$-$C_3$ alkyl. In some instances, at least one of $R_1$ and $R_2$ are methyl. For example, $R_1$ and $R_2$ can both be methyl. In some instances, $R_3$ is alkyl (e.g., $C_8$ alkyl) and x is 3. In some instances, $R_3$ is $C_{11}$ alkyl and x is 6. In some instances, $R_3$ is alkenyl (e.g., $C_8$ alkenyl) and x is 3. In some instances, x is 6 and $R_3$ is $C_{11}$ alkenyl. In some instances, $R_3$ is a straight chain alkyl, alkenyl, or alkynyl. In some instances, $R_3$ is —$CH_2$—$CH_2$—$CH_2$—$CH$=$CH$—$CH_2$—$CH_2$—$CH_2$—.

In another aspect, the two alpha, alpha disubstituted stereocenters are both in the R configuration or S configuration (e.g., i, i+4 cross-link), or one stereocenter is R and the other is S (e.g., i, i+7 cross-link). Thus, where formula I is depicted as:

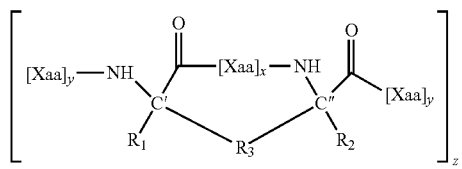

the C' and C" disubstituted stereocenters can both be in the R configuration or they can both be in the S configuration, e.g., when x is 3. When x is 6, the C' disubstituted stereocenter is in the R configuration and the C" disubstituted stereocenter is in the S configuration. The $R_3$ double bond can be in the E or Z stereochemical configuration.

In some instances, $R_3$ is $[R_4$—$K$—$R_4]_n$; and $R_4$ is a straight chain alkyl, alkenyl, or alkynyl.

In some embodiments, the disclosure features internally cross-linked ("stapled" or "stitched") peptides comprising the amino acid sequence of any one of SEQ ID NOs:1-38 (or a modified version thereof (e.g., SEQ ID NO:39, 55, or 57, or a modified version thereof), wherein the side chains of two amino acids separated by two, three, or six amino acids are replaced by an internal staple; the side chains of three amino acids are replaced by an internal stitch; the side chains of four amino acids are replaced by two internal staples, or the side chains of five amino acids are replaced by the combination of an internal staple and an internal stitch. In certain instances, the amino acids at one or more of positions Met-1, Leu-3, Lys-4, Asn-7, Leu-10, and Ala-11 of SEQ ID NO:1 are not replaced with a staple or stitch. In certain instances, the amino acids at one or more of positions Met-1, Pro-2, Ser-3, Ser-4, Glu-7, Arg-11, Lys-12, Leu-14, Lys-15, and Gln-18 of SEQ ID NO:2 are not replaced with a staple or stitch. In certain instances, the amino acids at one or more of positions $A_4$, $A_6$, $A_7$, $A_{10}$, and optionally $A_{13}$ of any one of SEQ ID NOs:3-20 and 22-34 are not replaced with a staple or stitch. In certain instances, the amino acids at one or more of positions Met-1, Arg-3, Ala-4, Ser-5, Leu-7, Lys-8, Arg-9, Leu-11, His-12, and Ala-15 of SEQ ID NO:21 are not replaced with a staple or stich. In certain instances, the amino acids at one or more of positions Val-3, Lys-8, Val-11, Lys-12, and Val-14 of SEQ ID NO:35 are not replaced with a staple or stitch. In certain instances, the amino acids at one or more of positions Lys-2, Ala-3, Gln-7, Leu-8, Gln-11, Lys-12, Ile-14, Asn-15, and Glu-16 of any one of SEQ ID NO:36 are not replaced with a staple or stitch. In certain instances, the amino acids at one or more of positions Leu-2, Ser-3, Ala-6, Gln-7, Arg-9, Lys-10, Arg-13, and Lys-14 of SEQ ID NO:37 are not replaced with a staple or stitch. In certain instances, the amino acids at one or more of positions Arg-5, Glu-7, Leu-8, Val-11, and Leu-14 of SEQ ID NO:38 are not replaced with a staple or stitch. The stapled/stitched peptide can be 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 amino acids in length. In a specific embodiment, the stapled/stitched peptide is 11, 12, 13, 14, 15, 16, 17, 18, 19, 20, 21, 22, 23, 24, or 25 amino acids in length. In a specific embodiment, the stapled/stitched peptide is 8, 9, 10, 11, 12, 13, 14, 15, 16, 17, or 18 amino acids in length. In a specific embodiment, the stapled/stitched peptide is 11 amino acids in length. In a specific embodiment, the stapled/stitched peptide is 12 amino acids in length. Exemplary E2 hA stapled peptides are shown in Tables 7, 8, and 11-15. In one embodiment, the E2 hA stapled peptide comprises or consists of the amino acid sequence set forth in SEQ ID NOs:65, 96, 101, and 132. In one embodiment, the E2 hA stapled peptide comprises or consists of the amino acid sequence set forth in SEQ ID NO:132. In one embodiment, the E2 hA stapled peptide comprises or consists of the amino acid sequence set forth in SEQ ID NOs:67, 97, 103, and 133. In one embodiment, the E2 hA stapled peptide comprises or consists of the amino acid sequence set forth in SEQ ID NOs:71 and 107. In certain embodiments, the stapled polypeptide comprises or consists of the amino acid sequence set forth in any one of SEQ ID NOs:1-39, 55-63, 792-806, wherein at least two amino acids separated by 2, 3 or 6 amino acids are modified to structurally stabilize the peptide (e.g., by substituting them with non-natural amino acids to permit hydrocarbon stapling). In certain embodiments, the stapled polypeptide comprises or consists of a variant of the amino acid sequence set forth in any one of SEQ ID NOs:1-39, 55-63, 792-806, wherein at least two amino acids separated by 2, 3 or 6 amino acids are modified to structurally stabilize the peptide (e.g., by substituting them with non-natural amino acids to permit hydrocarbon stapling). In certain embodiments, the stapled polypeptide comprises or consists of the amino acid sequence set forth SEQ ID NO:4 (or a modified version thereof), wherein at least two amino acids separated by 2, 3 or 6 amino acids are modified to structurally stabilize the peptide (e.g., by substituting them with non-natural amino acids to permit hydrocarbon stapling). In certain embodiments, the stapled polypeptide comprises or consists of the amino acid sequence set forth SEQ ID NO: 39 (or a modified version thereof), wherein at least two amino acids separated by 2, 3 or 6 amino acids are modified to structurally stabilize the peptide (e.g., by substituting them with non-natural amino acids to permit hydrocarbon stapling). In certain embodiments, the stapled polypeptide comprises or consists of the amino acid sequence set forth SEQ ID NO:6 (or a modified version thereof), wherein at least two amino acids separated by 2, 3 or 6 amino acids are modified to structurally stabilize the peptide (e.g., by substituting them with non-natural amino acids to permit hydrocarbon stapling). In certain embodiments, the stapled polypeptide comprises or consists of the amino acid sequence set forth SEQ ID NO:55 (or a modified version thereof), wherein at least two amino acids separated by 2, 3 or 6 amino acids are modified to structurally stabilize the peptide (e.g., by substituting them with non-natural amino acids to permit hydrocarbon stapling). In certain embodiments, the stapled polypeptide comprises or consists of the amino acid sequence set forth SEQ ID NO:10 (or a modified version thereof), wherein at least two amino acids separated by 2, 3 or 6 amino acids are modified to structurally stabilize the peptide (e.g., by substituting them with non-natural amino acids to permit hydrocarbon stapling). In certain embodiments, the stapled polypeptide comprises or consists of the amino acid sequence set forth SEQ ID NO:57 (or a modified version thereof), wherein at least two amino acids separated by 2, 3 or 6 amino acids are modified to structurally stabilize the peptide (e.g., by substituting them with non-natural amino acids to permit hydrocarbon stapling).

While hydrocarbon tethers are common, other tethers can also be employed in the E2 hA peptides described herein. For example, the tether can include one or more of an ether, thioether, ester, amine, or amide, or triazole moiety. In some cases, a naturally occurring amino acid side chain can be incorporated into the tether. For example, a tether can be coupled with a functional group such as the hydroxyl in serine, the thiol in cysteine, the primary amine in lysine, the acid in aspartate or glutamate, or the amide in asparagine or glutamine. Accordingly, it is possible to create a tether using naturally occurring amino acids rather than using a tether that is made by coupling two non-naturally occurring amino acids. It is also possible to use a single non-naturally occurring amino acid together with a naturally occurring amino acid. Triazole-containing (e.g., 1,4 triazole or 1,5 triazole) crosslinks can be used (see, e.g., Kawamoto et al. 2012 *Journal of Medicinal Chemistry* 55:1137; WO 2010/060112). In addition, other methods of performing different types of stapling are well known in the art and can be employed with the E2 hA peptides described herein (see, e.g., *Lactam stapling*: Shepherd et al., *J. Am. Chem. Soc.*, 127:2974-2983 (2005); *UV-cycloaddition stapling*: Madden et al., *Bioorg. Med. Chem. Lett.*, 21:1472-1475 (2011); *Disulfide stapling*: Jackson et al., *Am. Chem. Soc.*, 113:9391-9392 (1991); *Oxime stapling*: Haney et al., *Chem. Commun.*, 47:10915-10917 (2011); *Thioether stapling*: Brunel and Dawson, *Chem. Commun.*, 552-2554 (2005); *Photoswitchable stapling*: J. R. Kumita et al., *Proc. Natl. Acad. Sci. U.S.A.*, 97:3803-3808 (2000); *Double-click stapling*: Lau et al., *Chem. Sci.*, 5:1804-1809 (2014); *Bis-lactam stapling*: J. C. Phelan et al., *J. Am. Chem. Soc.*, 119:455-460 (1997); and *Bis-acylation stapling*: A. M. Spokoyny et al., *J. Am. Chem. Soc.*, 135:5946-5949 (2013)).

It is further envisioned that the length of the tether can be varied. For instance, a shorter length of tether can be used where it is desirable to provide a relatively high degree of constraint on the secondary alpha-helical structure, whereas, in some instances, it is desirable to provide less constraint on the secondary alpha-helical structure, and thus a longer tether may be desired.

Additionally, while tethers spanning from amino acids i to i+3, i to i+4, and i to i+7 are common in order to provide a tether that is primarily on a single face of the alpha helix, the tethers can be synthesized to span any combinations of numbers of amino acids and also used in combination to install multiple tethers.

In some instances, the hydrocarbon tethers (i.e., cross links) described herein can be further manipulated. In one instance, a double bond of a hydrocarbon alkenyl tether, (e.g., as synthesized using a ruthenium-catalyzed ring closing metathesis (RCM)) can be oxidized (e.g., via epoxidation, aminohydroxylation or dihydroxylation) to provide one of compounds below.

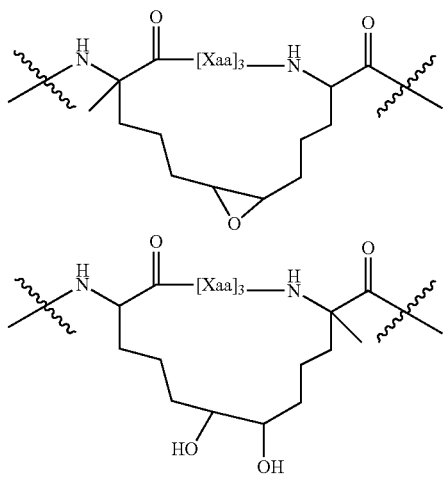

Either the epoxide moiety or one of the free hydroxyl moieties can be further functionalized. For example, the epoxide can be treated with a nucleophile, which provides additional functionality that can be used, for example, to attach a therapeutic agent. Such derivatization can alternatively be achieved by synthetic manipulation of the amino or carboxy-terminus of the polypeptide or via the amino acid side chain. Other agents can be attached to the functionalized tether, e.g., an agent that facilitates entry of the polypeptide into cells.

In some instances, alpha disubstituted amino acids are used in the polypeptide to improve the stability of the alpha helical secondary structure. However, alpha disubstituted amino acids are not required, and instances using mono-alpha substituents (e.g., in the tethered amino acids) are also envisioned.

The stapled polypeptides can include a drug, a toxin, a derivative of polyethylene glycol; a second polypeptide; a carbohydrate, etc. Where a polymer or other agent is linked to the stapled polypeptide is can be desirable for the composition to be substantially homogeneous.

The addition of polyethelene glycol (PEG) molecules can improve the pharmacokinetic and pharmacodynamic properties of the polypeptide. For example, PEGylation can reduce renal clearance and can result in a more stable plasma concentration. PEG is a water soluble polymer and can be represented as linked to the polypeptide as formula:

$XO-(CH_2CH_2O)_n-CH_2CH_2-Y$ where n is 2 to 10,000 and X is H or a terminal modification, e.g., a $C_{1-4}$ alkyl; and Y is an amide, carbamate or urea linkage to an amine group (including but not limited to, the epsilon amine of lysine or the N-terminus) of the polypeptide. Y may also be a maleimide linkage to a thiol group (including but not limited to, the thiol group of cysteine). Other methods for linking PEG to a polypeptide, directly or indirectly, are known to those of ordinary skill in the art. The PEG can be linear or branched. Various forms of PEG including various functionalized derivatives are commercially available.

PEG having degradable linkages in the backbone can be used. For example, PEG can be prepared with ester linkages that are subject to hydrolysis. Conjugates having degradable PEG linkages are described in WO 99/34833; WO 99/14259, and U.S. Pat. No. 6,348,558.

In certain embodiments, macromolecular polymer (e.g., PEG) is attached to an agent described herein through an intermediate linker. In certain embodiments, the linker is made up of from 1 to 20 amino acids linked by peptide bonds, wherein the amino acids are selected from the 20 naturally occurring amino acids. Some of these amino acids may be glycosylated, as is well understood by those in the art. In other embodiments, the 1 to 20 amino acids are selected from glycine, alanine, proline, asparagine, glutamine, and lysine. In other embodiments, a linker is made up of a majority of amino acids that are sterically unhindered, such as glycine and alanine. Non-peptide linkers are also possible. For example, alkyl linkers such as —NH(CH$_2$)$_n$C(O)—, wherein n=2-20 can be used. These alkyl linkers may further be substituted by any non-sterically hindering group such as lower alkyl (e.g., C$_1$-C$_6$) lower acyl, halogen (e.g., Cl, Br), CN, NH$_2$, phenyl, etc. U.S. Pat. No. 5,446,090 describes a bifunctional PEG linker and its use in forming conjugates having a peptide at each of the PEG linker termini.

The stapled peptides can also be modified, e.g., to further facilitate cellular uptake or increase in vivo stability, in some embodiments. For example, acylating or PEGylating a peptidomimetic macrocycle facilitates cellular uptake, increases bioavailability, increases blood circulation, alters pharmacokinetics, decreases immunogenicity and/or decreases the needed frequency of administration.

In some embodiments, the stapled peptides disclosed herein have an enhanced ability to penetrate cell membranes (e.g., relative to non-stapled peptides). See, e.g., International Publication No. WO 2017/147283, which is incorporated by reference herein in its entirety.

Methods of synthesizing the stabilized peptides described herein are known in the art. Nevertheless, the following exemplary method may be used. It will be appreciated that the various steps may be performed in an alternate sequence or order to give the desired compounds. Synthetic chemistry transformations and protecting group methodologies (protection and deprotection) useful in synthesizing the compounds described herein are known in the art and include, for example, those such as described in R. Larock, Comprehensive Organic Transformations, VCH Publishers (1989); T. W. Greene and P. G. M. Wuts, Protective Groups in Organic Synthesis, 3d. Ed., John Wiley and Sons (1999); L. Fieser and M. Fieser, Fieser and Fieser's Reagents for Organic Synthesis, John Wiley and Sons (1994); and L. Paquette, ed., Encyclopedia of Reagents for Organic Synthesis, John Wiley and Sons (1995), and subsequent editions thereof.

The peptides of this invention can be made by chemical synthesis methods, which are well known to the ordinarily skilled artisan. See, for example, Fields et al., Chapter 3 in Synthetic Peptides: A User's Guide, ed. Grant, W. H. Freeman & Co., New York, N.Y., 1992, p. 77. Hence, peptides can be synthesized using the automated Merrifield techniques of solid phase synthesis with the α-NH$_2$ protected by either t-Boc or Fmoc chemistry using side chain protected amino acids on, for example, an Applied Biosystems Peptide Synthesizer Model 430A or 431.

One manner of making of the peptides described herein is using solid phase peptide synthesis (SPPS). The C-terminal amino acid is attached to a cross-linked polystyrene resin via an acid labile bond with a linker molecule. This resin is insoluble in the solvents used for synthesis, making it relatively simple and fast to wash away excess reagents and by-products. The N-terminus is protected with the Fmoc group, which is stable in acid, but removable by base. Any side chain functional groups are protected with base stable, acid labile groups.

Longer peptides could be made by conjoining individual synthetic peptides using native chemical ligation. Alternatively, the longer synthetic peptides can be synthesized by well-known recombinant DNA techniques. Such techniques are provided in well-known standard manuals with detailed protocols. To construct a gene encoding a peptide of this invention, the amino acid sequence is reverse translated to obtain a nucleic acid sequence encoding the amino acid sequence, preferably with codons that are optimum for the organism in which the gene is to be expressed. Next, a synthetic gene is made, typically by synthesizing oligonucleotides which encode the peptide and any regulatory elements, if necessary. The synthetic gene is inserted in a suitable cloning vector and transfected into a host cell. The peptide is then expressed under suitable conditions appropriate for the selected expression system and host. The peptide is purified and characterized by standard methods.

The peptides can be made in a high-throughput, combinatorial fashion, e.g., using a high-throughput multiple channel combinatorial synthesizer available from Advanced Chemtech. Peptide bonds can be replaced, e.g., to increase physiological stability of the peptide, by: a retro-inverso bonds (C(O)—NH); a reduced amide bond (NH—CH$_2$); a thiomethylene bond (S—CH$_2$ or CH$_2$—S); an oxomethylene bond (O—CH$_2$ or CH$_2$—O); an ethylene bond (CH$_2$—CH$_2$); a thioamide bond (C(S)—NH); a trans-olefin bond (CH=CH); a fluoro substituted trans-olefin bond (CF=CH); a ketomethylene bond (C(O)—CHR) or CHR—C(O) wherein R is H or CH$_3$; and a fluoro-ketomethylene bond (C(O)—CFR or CFR—C(O) wherein R is H or F or CH$_3$.

The polypeptides can be further modified by: acetylation, amidation, biotinylation, cinnamoylation, farnesylation, fluoresceination, formylation, myristoylation, palmitoylation, phosphorylation (Ser, Tyr or Thr), stearoylation, succinylation and sulfurylation. As indicated above, peptides can be conjugated to, for example, polyethylene glycol (PEG); alkyl groups (e.g., C1-C20 straight or branched alkyl groups); fatty acid radicals; and combinations thereof α,α-Disubstituted non-natural amino acids containing olefinic side chains of varying length can be synthesized by known methods (Williams et al. *J. Am. Chem. Soc.*, 113:9276, 1991; Schafmeister et al., *J. Am. Chem Soc.*, 122:5891, 2000; and Bird et al., *Methods Enzymol.*, 446:369, 2008; Bird et al, *Current Protocols in Chemical Biology*, 2011). For peptides where an i linked to i+7 staple is used (two turns of the helix stabilized) either: a) one S5 amino acid and one R$_8$ is used; or b) one S8 amino acid and one R$_5$ amino acid is used. R$_8$ is synthesized using the same route, except that the starting chiral auxiliary confers the R-alkyl-stereoisomer. Also, 8-iodooctene is used in place of 5-iodopentene. Inhibitors are synthesized on a solid support using solid-phase peptide synthesis (SPPS) on MBHA resin (see, e.g., WO 2010/148335).

Fmoc-protected α-amino acids (other than the olefinic amino acids Fmoc-S$_5$—OH, Fmoc-R$_8$—OH, Fmoc-R$_8$—OH, Fmoc-S$_8$—OH and Fmoc-R$_5$—OH), 2-(6-chloro-1-H-benzotriazole-1-yl)-1,1,3,3-tetramethylaminium hexafluorophosphate (HCTU), and Rink Amide MBHA are commercially available from, e.g., Novabiochem (San Diego, CA). Dimethylformamide (DMF), N-methyl-2-pyrrolidinone (NMP), N,N-diisopropylethylamine (DIEA), trifluoroacetic acid (TFA), 1,2-dichloroethane (DCE), fluorescein isothiocyanate (FITC), and piperidine are commercially available from, e.g., Sigma-Aldrich. Olefinic amino acid synthesis is reported in the art (Williams et al., Org. Synth., 80:31, 2003).

Again, methods suitable for obtaining (e.g., synthesizing), stapling, and purifying the peptides disclosed herein are also known in the art (see, e.g., Bird et. al., Methods in Enzymol., 446:369-386 (2008); Bird et al, Current Protocols in Chemical Biology, 2011; Walensky et al., Science, 305:1466-1470 (2004); Schafmeister et al., J. Am. Chem. Soc., 122:5891-5892 (2000); U.S. patent application Ser. No. 12/525,123, filed Mar. 18, 2010; and U.S. Pat. No. 7,723,468, issued May 25, 2010, each of which are hereby incorporated by reference in their entirety).

In some embodiments, the peptides are substantially free of non-stapled peptide contaminants or are isolated. Methods for purifying peptides include, for example, synthesizing the peptide on a solid-phase support. Following cyclization, the solid-phase support may be isolated and suspended in a solution of a solvent such as DMSO, DMSO/dichloromethane mixture, or DMSO/NMP mixture. The DMSO/dichloromethane or DMSO/NMP mixture may comprise about 30%, 40%, 50% or 60% DMSO. In a specific embodiment, a 50%/50% DMSO/NMP solution is used. The solution may be incubated for a period of 1, 6, 12 or 24 hours, following which the resin may be washed, for example with dichloromethane or NMP. In one embodiment, the resin is washed with NMP. Shaking and bubbling an inert gas into the solution may be performed.

Also provided herein is a method of producing a stabilized peptide comprising: (a) stapling or stitching an E2 hA peptide; and (b) isolating the stapled or stitched peptide.

Properties of the stapled (cross-linked) polypeptides of the invention can be assayed, for example, using the methods described below and in the Examples.

Assays to Determine α-Helicity: Compounds are dissolved in an aqueous solution (e.g., 5 mM potassium phosphate solution at pH 7, or distilled $H_2O$, to concentrations of 25-50 μM). Circular dichroism (CD) spectra are obtained on a spectropolarimeter (e.g., Jasco J-710, Aviv) using standard measurement parameters (e.g., temperature, 20° C.; wavelength, 190-260 nm; step resolution, 0.5 nm; speed, 20 nm/sec; accumulations, 10; response, 1 sec; bandwidth, 1 nm; path length, 0.1 cm). The α-helical content of each peptide is calculated by dividing the mean residue ellipticity by the reported value for a model helical decapeptide (Yang et al., Methods Enzymol. 130:208 (1986)).

Assays to Determine Melting Temperature (Tm): Cross-linked or the unmodified template peptides are dissolved in distilled $H_2O$ or other buffer or solvent (e.g., at a final concentration of 50 μM) and Tm is determined by measuring the change in ellipticity over a temperature range (e.g., 4 to 95° C.) on a spectropolarimeter (e.g., Jasco J-710, Aviv) using standard parameters (e.g., wavelength 222 nm; step resolution, 0.5 nm; speed, 20 nm/sec; accumulations, 10; response, 1 sec; bandwidth, 1 nm; temperature increase rate: 1° C./min; path length, 0.1 cm).

In vitro Protease Resistance Assays: The amide bond of the peptide backbone is susceptible to hydrolysis by proteases, thereby rendering peptidic compounds vulnerable to rapid degradation in vivo. Peptide helix formation, however, typically buries and/or twists and/or shields the amide backbone and therefore may prevent or substantially retard proteolytic cleavage. The peptidomimetic macrocycles of the present invention may be subjected to in vitro enzymatic proteolysis (e.g., trypsin, chymotrypsin, pepsin) to assess for any change in degradation rate compared to a corresponding uncrosslinked or alternatively stapled polypeptide. For example, the peptidomimetic macrocycle and a corresponding uncrosslinked polypeptide are incubated with trypsin agarose and the reactions quenched at various time points by centrifugation and subsequent HPLC injection to quantitate the residual substrate by ultraviolet absorption at 280 nm. Briefly, the peptidomimetic macrocycle and peptidomimetic precursor (5 mcg) are incubated with trypsin agarose (Pierce) (S/E~125) for 0, 10, 20, 90, and 180 minutes. Reactions are quenched by tabletop centrifugation at high speed; remaining substrate in the isolated supernatant is quantified by HPLC-based peak detection at 280 nm. The proteolytic reaction displays first order kinetics and the rate constant, k, is determined from a plot of ln[S] versus time.

Peptidomimetic macrocycles and/or a corresponding uncrosslinked polypeptide can be each incubated with fresh mouse, rat and/or human serum (e.g., 1-2 mL) at 37° C. for, e.g., 0, 1, 2, 4, 8, and 24 hours. Samples of differing macrocycle concentration may be prepared by serial dilution with serum. To determine the level of intact compound, the following procedure may be used: The samples are extracted, for example, by transferring 100 μL of sera to 2 ml centrifuge tubes followed by the addition of 10 μL of 50% formic acid and 500 μL acetonitrile and centrifugation at 14,000 RPM for 10 min at 4+/−2° C. The supernatants are then transferred to fresh 2 ml tubes and evaporated on Turbovap under $N_2$<10 psi, 37° C. The samples are reconstituted in 100 μL of 50:50 acetonitrile:water and submitted to LC-MS/MS analysis. Equivalent or similar procedures for testing ex vivo stability are known and may be used to determine stability of macrocycles in serum.

In vivo Protease Resistance Assays: A key benefit of peptide stapling is the translation of in vitro protease resistance into markedly improved pharmacokinetics in vivo.

In vitro Binding Assays: To assess the binding and affinity of peptidomimetic macrocycles and peptidomimetic precursors to acceptor proteins, a fluorescence polarization assay (FPA) can be used, for example. The FPA technique measures the molecular orientation and mobility using polarized light and fluorescent tracer. When excited with polarized light, fluorescent tracers (e.g., FITC) attached to molecules with high apparent molecular weights (e.g., FITC-labeled peptides bound to a large protein) emit higher levels of polarized fluorescence due to their slower rates of rotation as compared to fluorescent tracers attached to smaller molecules (e.g., FITC-labeled peptides that are free in solution).

In vitro Enzyme Inhibition Assays: To assess an E2 hA peptide's inhibition of an E1 enzyme, an in vitro enzyme inhibition assay can be used, for example. The in vitro enzyme inhibition assay measures an E2 hA peptide's ability to inhibit conjugation of ubiquitin to E2 by E1. Briefly, recombinant E1 (e.g., UBA1), recombinant E2 (e.g., UBE2A), ubiquitin, and Mg-ATP are combined in the presence of an E2 hA peptide or vehicle control (e.g., 1% DMSO) for a period of time (e.g., 30 minutes) at room temperature in a buffer containing, e.g., 50 mM NaCl, 50 mM HEPES pH 7.5. Control reaction includes no E1. Reactions are quenched by addition of SDS-containing loading dye and samples are resolved on a gel (e.g., a 4-12% Bis-Tris protein gel) under nonreducing conditions. Proteins on the gel are visualized via, e.g., silver stain. Conjugation of ubiquitin to E2 by E1 is monitored by conversion of free E2 (~17 kDa) to E2~ubiquitin conjugate (~26 kDa).

Stabilized E2 hA Peptide Variants

In some embodiments, internally cross-linked peptides can be made by modifying (e.g., by amino acid substitution) a peptide of any one of SEQ ID NOs:1-38 or a modified version thereof (i.e., a variant thereof (e.g., SEQ ID NO:39, 55, or 57). In some embodiments, an internal staple replaces the side chains of 2 amino acids, i.e., each staple is between two amino acids separated by, for example, 2, 3, or 6 amino acids. In some embodiments, an internal stitch replaces the side chains of 3 amino acids, i.e., the stitch is a pair of crosslinks between three amino acids separated by, for example, 3 and 6 amino acids. In some embodiments, the internal staples and/or the internal stitch comprise at least two internal staples (replacing the side chains of 4 amino acids, i.e., each staple is between two amino acids separated by, for example, 3 amino acids). In some embodiments, the internal staples and/or the internal stitch comprise a combination of at least one internal staple and an internal stitch. In some embodiments, the internal stitch replaces the side chain of a first amino acid and a second and a third amino acid thereby cross-linking the first amino acid (which lies between the second and third amino acids) to the second and third amino acid via an internal cross-link, wherein the first and second amino acid are separated by two, three, or six amino acids, the first and the third amino acids are separated by two, three, or six amino acids, and the second and third amino acids are distinct amino acids. In some embodiments, the side chains of the four amino acids of the internally cross-linked polypeptides of the disclosure are replaced by two distinct internal staples. In some embodiments, a first of the two distinct internal staples cross-links a first pair of amino acids separated by two, three, or six amino acids, and a second of the at least two distinct internal staples cross-links a second pair of amino acids separated by two, three, or six amino acids.

The stapled polypeptide comprises at least two modified amino acids joined by an internal intramolecular cross-link (or "staple"), wherein the at least two amino acids are separated by 2, 3, or 6 amino acids. Stabilized peptides herein include stapled peptides, including peptides having two staples and/or stitched peptides. The at least two modified amino acids can be unnatural alpha-amino acids (including, but not limited to α,α-disubstituted and N-alkylated amino acids). There are many known unnatural amino acids any of which may be included in the peptides of the present invention. Some examples of unnatural amino acids are 4-hydroxyproline, desmosine, gamma-aminobutyric acid, beta-cyanoalanine, norvaline, 4-(E)-butenyl-4(R)-methyl-N-methyl-L-threonine, N-methyl-L-leucine, 1-amino-cyclopropanecarboxylic acid, 1-amino-2-phenyl-cyclopropanecarboxylic acid, 1-amino-cyclobutanecarboxylic acid, 4-amino-cyclopentenecarboxylic acid, 3-amino-cyclohexanecarboxylic acid, 4-piperidylacetic acid, 4-amino-1-methylpyrrole-2-carboxylic acid, 2,4-diaminobutyric acid, 2,3-diaminopropionic acid, 2,4-diaminobutyric acid, 2-aminoheptanedioic acid, 4-(aminomethyl)benzoic acid, 4-aminobenzoic acid, ortho-, meta- and/para-substituted phenylalanines (e.g., substituted with —C(═O)$C_6H_5$; —$CF_3$; —CN; -halo; —NO2; $CH_3$), disubstituted phenylalanines, substituted tyrosines (e.g., further substituted with -Q=O) $C_6H_5$; —$CF_3$; —CN; -halo; —$NO_2$; $CH_3$), and statine.

In some embodiments, internally cross-linked E2 hA peptide variants of the disclosure are prepared from a polypeptide of any one of SEQ ID NOs:1-38 and having e.g., 1, 2, 3, 4, 5, 6, 7, 8, or 9 amino acid substitutions (e.g., 1, 2, 3, 4, 5, 6, 7, 8, or 9 amino acids are conservatively or non-conservatively substituted) and/or having, e.g., 1, 2, 3, 4, 5, 6, 7, 8, or 9 amino acid deletions from the N- and/or C-terminus (e.g., 1, 2, 3, 4, 5, 6, 7, 8, or 9 amino acids from the N- and/or C-terminus are deleted). Exemplary E2 hA peptides, including variants, are provided in Tables 1-6. For example, in certain embodiments, the internally cross-linked E2 hA peptide variants of this disclosure can have 1, 2, 3, 4, 5, 6, 7, 8, 9, 10, 11, 12, or 13 amino acid substitutions in any one of SEQ ID NOs:1-38 (e.g., 1, 2, 3, 4, 5, 6, 7, 8, 9, 10, 11, 12, or 13 amino acids are conservatively or non-conservatively substituted). In some instances, one to three amino acids of any one of SEQ ID NOs:1-38 are substituted. The amino acid substitutions in any one of SEQ ID NOs:1-38 can be of amino acids that directly interact with (or are predicted to directly interact with) or do not engage in direct interaction with (or are predicted to not engage in direct interaction with) the E2 hA's cognate E1 enzyme. Much greater variability is permitted in the amino acids that do not engage in direct interaction with (or are predicted to not engage in direct interaction with) the E2 hA's cognate E1 enzyme than in the amino acids that directly interact with (or are predicted to directly interact with) the E2 hA's cognate E1 enzyme. In fact, just about every one of the amino acids that do not engage in direct interaction with (or are predicted to not engage in direct interaction with) the E2 hA's cognate E1 enzyme (e.g., 5, 4, 3, 2, or 1 amino acid of the non-directly interacting amino acids (or predicted to not directly interact)) can be substituted (e.g., conservative or non-conservative amino acid substitutions or substitution with alanine). In certain embodiments, 1, 2, or 3 amino acids that directly interact with (or are predicted to directly interact with) the E2 hA's cognate E1 enzyme are substituted with another amino acid. In some instances, the substitution(s) is/are a conservative amino acid substitution. In other instances, the substitution(s) is/are a non-conservative amino acid substitution. In some instances, where there are more than one amino acid substitutions, the substitutions are both conservative and non-conservative amino acid substitutions. In some instances, where there are more than one amino acid substitutions, each of the substitutions are conservative amino acid substitutions. In some cases, where one to three amino acids (e.g., 1, 2, or 3) of any one of SEQ ID NOs:1-38 are substituted, the substitutions are all of amino acids that do not engage in direct interaction with (or are predicted to not engage in direct interaction with) the E2 hA's cognate E1 enzyme. In some cases, where one to three amino acids (e.g., 1, 2, or 3) of any one of SEQ ID NOs:1-38 are substituted, the substitutions are all of amino acids that directly interact with (or are predicted to directly interact with) the E2 hA's cognate E1 enzyme. In some cases, where one to three amino acids (e.g., 1, 2, or 3) of any one of SEQ ID NOs:1-38 are substituted, the substitutions are both of amino acids that directly interact with (or are predicted to directly interact with) the E2 hA's cognate E1 enzyme and of amino acids that do not engage in direct interaction with (or are predicted to not engage in direct interaction with) the E2 hA's cognate E1 enzyme. In certain instances, the substituted amino acid(s) are selected from the group consisting of L-Ala, D-Ala, Aib, Sar, Ser, a substituted alanine, or a substituted glycine derivative. In certain instances, a modified Ubc15 E2 hA peptide comprises the E7 residue (numbering according to SEQ ID NO:2) substituted with arginine.

In certain embodiments, the internally cross-linked E2 hA peptide variants of this disclosure can have 1, 2, 3, 4, or 5, amino acid removed/deleted from the C-terminus of the sequence set forth in any one of SEQ ID NOs:1-38. For example, in certain embodiments, an internally cross-linked E2 hA peptide variant of this disclosure comprises or consists of a modified amino acid sequence of the amino acid sequence set forth in SEQ ID NO:4, wherein two amino acids are removed/deleted from the C-terminus of the sequence of SEQ ID NO:4 (e.g., the internally cross-linked E2 hA peptide variant comprises or consists of the amino acid sequence of SEQ ID NO:39). In another example, in certain embodiments, an internally cross-linked E2 hA peptide variant of this disclosure comprises or consists of a modified amino acid sequence of the amino acid sequence set forth in SEQ ID NO:6, wherein five amino acids are removed/deleted from the C-terminus of the sequence of SEQ ID NO:6 (e.g., the internally cross-linked E2 hA peptide variant comprises or consists of the amino acid sequence of SEQ ID NO:55). In certain embodiments, the internally cross-linked E2 hA peptide variants of this disclosure can have 1, 2, 3, 4, or 5, amino acid removed/deleted from the N-terminus of the sequence set forth in any one of SEQ ID NOs:1-38. In certain embodiments, the UBA1-binding E2 hA peptides of this disclosure can have amino acid positions $A_{12}$-$A_{16}$ removed/deleted from the C-terminus of the sequence set forth in any one of SEQ ID NOs:1-34. In certain embodiments, the UBA1-binding internally cross-linked E2 hA peptide variants of this disclosure can have 1, 2, 3, or all of the amino acid positions N-terminal to amino acid position $A_1$ removed/deleted from the N-terminus of the sequence set forth in any one of SEQ ID NOs:1-34. In certain embodiments, the internally cross-linked E2 hA peptide variants of this disclosure can have 1, 2, 3, 4, or 5, amino acid removed/deleted from both the N-terminus and C-terminus of the sequence set forth in any one of SEQ ID NOs:1-38. In certain embodiments, the UBA1-binding internally cross-linked E2 hA peptide variants of this disclosure can have 1, 2, 3, 4, or 5 amino acids removed/deleted from the C-terminus of the sequence set forth in any one of SEQ ID NOs:1-34 and 1, 2, 3, or all of the amino acids N-terminal to amino acid position $A_1$ removed/deleted from the N-terminus of the sequence. In certain instances, these removed amino acids can be replaced with 1-6 (e.g., 1, 2, 3, 4, 5, or 6) amino acids selected from the group consisting of L-Ala, D-Ala, Aib, Sar, Ser, a substituted alanine, or a substituted glycine derivative.

In certain instances, the internally cross-linked E2 hA peptide or variant has an amino acid sequence set forth in any one of Tables 7, 8, and 11-15.

The internally cross-linked E2 hA peptide variants described herein can be optimized for therapeutic use. For example, if any of the above-described internally cross-linked E2 hA peptide variants cause membrane disruption (cell lysis), the peptides can be optimized by lowering the overall peptide hydrophobicity. This can for example be achieved by substituting especially hydrophobic residues with an amino acid with lower hydrophobicity (e.g., alanine). Membrane disruption can also be lowered by reducing the overall positive charge of the peptide. This can be accomplished by substituting basic residues with uncharged or acidic residues. In certain instances, both the overall peptide hydrophobicity and the overall positive charge of the peptide are lowered.

In certain embodiments, the internally cross-linked E2 hA peptide variants described herein are between 5 and 35 amino acids in length, between 5 and 25 amino acids in length, between 5 and 20 amino acids in length, between 5 and 18 amino acids in length, between 10 and 35 amino acids in length, between 10 and 25 amino acids in length, between 10 and 20 amino acids in length, between 10 and 18 amino acids in length, between 15 and 26 amino acids in length, or between 15 and 18 amino acids in length. In certain embodiments, the internally cross-linked E2 hA peptide variants described herein are 11, 12, 13, 14, 15, 16, 17, 18, or 19 amino acids in length.

In certain embodiments, the stapled E2 hA peptide variant comprises or consists of the amino acid sequence set forth in any one of Tables 7, 8, and 11-15. A non-limiting example of structural stabilization of these peptides is achieved by hydrocarbon stapling by introducing non-natural amino acids at positions separated by 2, 3, or 6 amino acids in these sequences.

Warhead Bearing Stabilized E2 hA Peptide Variants

This disclosure features stabilized UBA1-binding E2 hA peptides that include a warhead—i.e., a reactive group such as a non-natural amino acid bearing an electrophilic group. Importantly, these warhead containing peptides allow for significant variability in the amino acid sequence of the associated E2 hA peptide (much more than in the absence of the warhead) as the non-covalent interaction between the UBA1-binding E2 hA peptide and the E1 is cemented by the covalent bond between the electrophile and the cysteine at position Cys-1039 of UBA1 (i.e., position 1039 of SEQ ID NO:845). Thus, even if there are substitutions and/or deletions in any one of SEQ ID NOs:1-34, including substitutions of amino acids that directly interact with (or are predicted to directly interact with) the E2 hA's cognate E1 enzyme (e.g., positions $A_4$, $A_5$, $A_7$, and $A_{10}$ for SEQ ID NOs:3-20 and 22-34), these warhead bearing peptides are likely to be effective in binding UBA1. Furthermore, with the warhead present, the size of the E2 hA peptide (e.g., any one of sequences of Tables 1, 2, 6, and 7) can be reduced in length (e.g., to 14, 13, 12, 11, 10, 9, 8, 7, 6, or 5 amino acids).

The electrophile can be installed not only in the context of a non-natural amino acid, but also as a chemical cap to the N- or C-terminus of the stabilized (e.g., cross-linked) E2 hA peptide. In some instances, the electrophile can be installed within the stabilized peptide. Such warhead bearing stabilized peptides are able to form covalent bonds with at least some of the proteins they interact with. For example, such warhead bearing E2 hA peptides can covalently modify UBA1 (e.g., by covalent bonding with Cys1039 of UBA1 and noncovalently interact with UBA1.

The warheads may be at the N-terminus, C-terminus, or within the polypeptide sequence. In certain embodiments, the warhead is at position $A_7$. In certain embodiments, the warhead is at position $A_8$. In certain embodiments, the warhead is at position $A_{11}$. In some cases, the warhead is a non-natural electrophile bearing amino acid. In certain embodiments, the warhead is selected from the group consisting of: diamino butanoic acid terminating in bromoacetyl, diamino butanoic acid terminating in acrylamide; 3S-1-pyrrolidine-3-carboxylic acid terminating in acrylamide; D-homoproline terminating in acrylamide; L-homoproline terminating in acrylamide; isonipecotic acid terminating in acrylamide; D-nipecotic acid terminating in acrylamide; L-nipecotic acid terminating in acrylamide; D-proline terminating in acrylamide; L-proline terminating in acrylamide; trans-4-dimethylaminocrotonic acid; and acrylic acid. In certain embodiments, the warhead is diamino butanoic acid terminating in bromoacetyl. In certain embodiments, the warhead is diamino butanoic acid terminating in acrylamide.

In some embodiments, the electrophilic warhead is a cysteine-reactive D-nipecotic acid moiety. In other embodiments, the electrophilic warhead is a cysteine-reactive moiety.

In certain embodiments, the warhead is a non-natural amino acid bearing an electrophilic group that is selected from the group consisting of: (S)-1-acryloylpyrrolidine-3-carboxamide; 1-acrylopiperidine-4-carboxamide; (R)-1 acryloylpiperidine-3-carboxamide; (S)-1-acryloylpiperidine-3-carboxamide; (S)-1-acryloylpyyrolidine-2-carboxamide; (R)-1-acryloylpyrrolidine-2-carboxamide; (E)-4-(dimethylamino)but-2-enamide; and acrylamide. In other embodiments, the warhead is not an amino acid. For example, the electrophilic moiety and peptide are linked via a nitrogen containing heterocycle, either saturated (aziridine, diaziridine, azetidine, pyrrolidine, imidazolidine, pyrazolidine, oxazolidine, isoxazolidine, thiazolidine, isothiazolidine, piperidine, piperazine, morpholine, thiomorpholine, azepane) or unsaturateed (azirine, diazirine, azete, pyrrole, imidazole, pyrazole, oxazole, isoxazole, thiazole, isothiazole, pyridine, diazines, oxazine, thiazine, azepine). The peptide and electrophile can also be linked by a substituted amino-functionalized ring (e.g., N-arylacrylamide) such as phenyl (aniline) or by more complex bicyclic or polycyclic rings, for instance, naphthalene, anthracene, phenanthrene, indole, isoindole, indolizine, quinolone, isoquinoline, quinoxaline, phthalzine, quinazoline, purine, carbazole, indazole, benzimidazole, azaindole. The electrophilic warhead in some embodiments is an acrylamide, or more generally defined as an α,β-unsaturated carbonyl, such as α-cyanoacrylamide, propiolamide, trans 4-dimethylamino-2-butenamide, or trans 4-piperidinyl-2-butenamide, or any other substituted acrylamide, or N-functionalized vinylsulfonyl, alpha-fluoro acetyl, alpha-chloro acetyl, alpha-bromo acetyl, and alpha-iodo acetyl or other electrophilic moiety. The electrophile can not only be installed in the context of a non-natural amino acid, but also as a chemical cap to the N or C terminus of the cross-linked (e.g., stapled, stitched) polypeptide.

In one aspect, the UBA1-binding, warhead-bearing E2 hA comprises or consists of an amino acid sequence set out in any one of SEQ ID NOs:1-34, or a modified version thereof described herein above or in the examples (e.g., SEQ ID NO:39, 55, or 57), and is modified to include a warhead. In another aspect, the UBA1-binding warhead bearing E2 hA peptide comprises or consists of an amino acid sequence set out in any one of SEQ ID NOs:1-34, or a modified version thereof (e.g., SEQ ID NO:39, 55, or 57) and is modified to include a warhead. In another aspect, the UBA1-binding, warhead-bearing E2 hA peptide comprises or consists of an amino acid sequence that contains 5 or more (e.g., 5, 6, 7, 8, 9, 10, 11, 12, 13, 14) amino acids of a sequence set out in any one of SEQ ID NOs:1-34 and is modified to include a warhead. In another aspect, the UBA1-binding, warhead-bearing E2 hA peptide comprises or consists of an amino acid sequence that contains 1-8 deletions (e.g., 1, 2, 3, 4, 5, 6, 7, or 8) at the C- or N-terminus of a sequence set out in any one of SEQ ID NOs: 1-34 and is modified to include a warhead. In another aspect, the UBA1-binding, warhead-bearing E2 hA peptide comprises or consists of an amino acid sequence set forth in any one of Tables 1, 2, 6, and 7 modified to include a warhead. In some instances, the electrophilic warhead is at the N-terminus of the peptide. In other instances, the electrophilic warhead is within the peptide, e.g., at position $A_7$, $A_8$, or $A_{11}$.

In one embodiment, the UBA1-binding, warhead-bearing E2 hA peptide has a sequence selected from the sequences set out in Table 10 below.

TABLE 10

Exemplary warhead-bearing peptides. SEQ ID NOs: 144-251 and 827-829 (from top to bottom, respectively): "J" is a non-natural electrophile containing amino acid or an electrophilic warhead presented in the context of a moiety that is not an amino acid (the electrophile can serve as a chemical cap). SEQ ID NOs: 252-359 and 830-832 (from top to bottom, respectively): "J" is diamino butanoic acid terminating in acrylamide or diamino butanoic acid terminating in bromoacetyl. "tr" = truncated; "m" = mutant

| SEQ ID NO: | Gene | Sequence |
|---|---|---|
| 144, 252 | UBE2K | M A N I A V Q R I J R E F K E V L K S |
| 145, 253 | UBE2A/UBE2B | M S T P A R R R L J R D F K R L Q E D |
| 146, 254 | UBE2G1 | M T E L Q S A L L L J R Q L A E L N K N |
| 147, 255 | UBE2G2 | M A G T A L K R L J A E Y K Q L T L N |
| 148, 256 | UBE2R1 | M A R P L V P S S Q K A L J L E L K G L Q E E |
| 149, 257 | UBE2R2 | M A Q Q Q M T S S Q K A L J L E L K S L Q E E |
| 150, 258 | UBE2D1 | M A L K R I J K E L S D L Q R D |
| 151, 259 | UBE2D2 | M A L K R I J K E L N D L A R D |
| 152, 260 | UBE2D3 | M A L K R I J K E L S D L A R D |
| 153, 261 | UBE2D4 | M A L K R I J K E L T D L Q R D |
| 154, 262 | UBE2E1 | K N S K L L S T S A K R I J K E L A D I T L D |
| 155, 263 | UBE2E2 | K T A A K L S T S A K R I J K E L A E I T L D |
| 156, 264 | UBE2E3 | K T T A K L S T S A K R I J K E L A E I T L D |
| 157, 265 | UBE2U | M H G R A Y L L L H J D F C D L K E N N |

TABLE 10-continued

Exemplary warhead-bearing peptides. SEQ ID NOs: 144-251 and 827-829 (from top to bottom, respectively): "J" is a non-natural electrophile containing amino acid or an electrophilic warhead presented in the context of a moiety that is not an amino acid (the electrophile can serve as a chemical cap). SEQ ID NOs: 252-359 and 830-832 (from top to bottom, respectively): "J" is diamino butanoic acid terminating in acrylamide or diamino butanoic acid terminating in bromoacetyl. "tr" = truncated; "m" = mutant

| SEQ ID NO: | Gene | Sequence |
|---|---|---|
| 158, 266 | UBE2J1 | M E T R Y N L K S P A V K R L J K E A A E L K D P |
| 159, 267 | UBE2J2 | M S S T S S K R A P T T A T Q R L J Q D Y L R I K K D |
| 160, 268 | UBE2N | M A G L P R R I J K E T Q R L L A E |
| 161, 269 | UBE2NL | M A E L P H R I J K E T Q R L L A E |
| 162, 270 | UBE2T | M Q R A S R L J R E L H M L A T E |
| 163, 271 | UBE2V1 | M A A T T G S G V K V P R N F R L J E E L E E G Q K G |
| 164, 272 | UBE2V2 | M A V S T G V K V P R N F R L J E E L E E G Q K G |
| 165, 273 | UBE2S | M N S N V E N L P P H I I R L V J K E V T T L T A D |
| 166, 274 | UBE2C | A R G P V G K R L J Q E L M T L M M S |
| 167, 275 | UBE2W | M A S M Q K R L J K E L L A L Q N D |
| 168, 276 | UBE2O | A K K F F S T V J K E M A L L A T S |
| 169, 277 | BIRC6 | A N D A N S A A R A R R L J Q E A V T L S T S |
| 170, 278 | UBE2L3 | M A A S R R L J K E L E E I R K C |
| 171, 279 | UBE2L6 | M M A S M R V J K E L E D L Q K K |
| 172, 280 | FTS | G P F Y L E Y S L J A E F T L V V K Q |
| 173, 281 | UBE2Q | G A V S G S V Q A T D R L J K E L R D I Y R S |
| 174, 282 | UBE2Q2 | G A V S G S V Q A S D R L J K E L R D I Y R S |
| 175, 283 | UBE2H | M S S P S P G K R R M J T D V V K L I E S |
| 176, 284 | UBE2A-tr/UBE2B-tr | M S T P A R R R L J R D F K R L Q |
| 177, 285 | UBE2G2-tr | M A G T A L K R L J A E Y K |
| 178, 286 | Ubc4 | M A L K R I J R E L A D L G K D |
| 179, 287 | Ubc15 | M P S S A S E Q L L J K Q L K E I Q K N |
| 180, 288 | UBE2K | M A N I A V Q R I K J E F K E V L K S |
| 181, 289 | UBE2A/UBE2B | M S T P A R R R L M J D F K R L Q E D |
| 182, 290 | UBE2G1 | M T E L Q S A L L L R J Q L A E L N K N |
| 183, 291 | UBE2G2 | M A G T A L K R L M J E Y K Q L T L N |
| 184, 292 | UBE2R1 | M A R P L V P S S Q K A L L J E L K G L Q E E |
| 185, 293 | UBE2R2 | M A Q Q Q M T S S Q K A L M J E L K S L Q E E |
| 186, 294 | UBE2D1 | M A L K R I Q J E L S D L Q R D |
| 187, 295 | UBE2D2 | M A L K R I H J E L N D L A R D |
| 188, 296 | UBE2D3 | M A L K R I N J E L S D L A R D |
| 189, 297 | UBE2D4 | M A L K R I Q J E L T D L Q R D |
| 190, 298 | UBE2E1 | K N S K L L S T S A K R I Q J E L A D I T L D |
| 191, 299 | UBE2E2 | K T A A K L S T S A K R I Q J E L A E I T L D |

TABLE 10-continued

Exemplary warhead-bearing peptides. SEQ ID NOs: 144-251 and 827-829 (from top to bottom, respectively): "J" is a non-natural electrophile containing amino acid or an electrophilic warhead presented in the context of a moiety that is not an amino acid (the electrophile can serve as a chemical cap). SEQ ID NOs: 252-359 and 830-832 (from top to bottom, respectively): "J" is diamino butanoic acid terminating in acrylamide or diamino butanoic acid terminating in bromoacetyl. "tr" = truncated; "m" = mutant

| SEQ ID NO: | Gene | Sequence |
|---|---|---|
| 192, 300 | UBE2E3 | K T T A K L S T S A K R I Q J E L A E I T L D |
| 193, 301 | UBE2U | M H G R A Y L L L H R J F C D L K E N N |
| 194, 302 | UBE2J1 | M E T R Y N L K S P A V K R L M J E A A E L K D P |
| 195, 303 | UBE2J2 | M S S T S S K R A P T T A T Q R L K J D Y L R I K K D |
| 196, 304 | UBE2N | M A G L P R R I I J E T Q R L L A E |
| 197, 305 | UBE2NL | M A E L P H R I I J E T Q R L L A E |
| 198, 306 | UBE2T | M Q R A S R L K J E L H M L A T E |
| 199, 307 | UBE2V1 | M A A T T G S G V K V P R N F R L L J E L E E G Q K G |
| 200, 308 | UBE2V2 | M A V S T G V K V P R N F R L L J E L E E G Q K G |
| 201, 309 | UBE2S | M N S N V E N L P P H I I R L V Y J E V T T L T A D |
| 202, 310 | UBE2C | A R G P V G K R L Q J E L M T L M M S |
| 203, 311 | UBE2W | M A S M Q K R L Q J E L L A L Q N D |
| 204, 312 | UBE2O | A K K F F S T V R J E M A L L A T S |
| 205, 313 | BIRC6 | A N D A N S A A R A R R L A J E A V T L S T S |
| 206, 314 | UBE2L3 | M A A S R R L M J E L E E I R K C |
| 207, 315 | UBE2L6 | M M A S M R V V J E L E D L Q K K |
| 208, 316 | FTS | G P F Y L E Y S L L J E F T L V V K Q |
| 209, 317 | UBE2Q | G A V S G S V Q A T D R L M J E L R D I Y R S |
| 210, 318 | UBE2Q2 | G A V S G S V Q A S D R L M J E L R D I Y R S |
| 211, 319 | UBE2H | M S S P S P G K R R M D J D V V K L I E S |
| 212, 320 | UBE2A-tr/UBE2B-tr | M S T P A R R R L M J D F K R L Q |
| 213, 321 | UBE2G2-tr | M A G T A L K R L M J E Y K |
| 214, 322 | Ubc4 | M A L K R I N J E L A D L G K D |
| 215, 323 | Ubc15 | M P S S A S E Q L L R J Q L K E I Q K N |
| 216, 324 | UBE2K | M A N I A V Q R I K R E F J E V L K S |
| 217, 325 | UBE2A/UBE2B | M S T P A R R R L M R D F J R L Q E D |
| 218, 326 | UBE2G1 | M T E L Q S A L L L R R Q L J E L N K N |
| 219, 327 | UBE2G2 | M A G T A L K R L M A E Y J Q L T L N |
| 220, 328 | UBE2R1 | M A R P L V P S S Q K A L L L E L J G L Q E E |
| 221, 329 | UBE2R2 | M A Q Q Q M T S S Q K A L M L E L J S L Q E E |
| 222, 330 | UBE2D1 | M A L K R I Q K E L J D L Q R D |
| 223, 331 | UBE2D2 | M A L K R I H K E L J D L A R D |
| 224, 332 | UBE2D3 | M A L K R I N K E L J D L A R D |
| 225, 333 | UBE2D4 | M A L K R I Q K E L J D L Q R D |

TABLE 10-continued

Exemplary warhead-bearing peptides. SEQ ID NOs: 144-251 and 827-829
(from top to bottom, respectively): "J" is a non-natural electrophile containing
amino acid or an electrophilic warhead presented in the context of a moiety that is
not an amino acid (the electrophile can serve as a chemical cap). SEQ ID NOs: 252-359
and 830-832 (from top to bottom, respectively): "J" is diamino butanoic acid terminating
in acrylamide or diamino butanoic acid terminating in bromoacetyl. "tr" = truncated;
"m" = mutant

| SEQ ID NO: | Gene | Sequence |
|---|---|---|
| 226, 334 | UBE2E1 | K N S K L L S T S A K R I Q K E L J D I T L D |
| 227, 335 | UBE2E2 | K T A A K L S T S A K R I Q K E L J E I T L D |
| 228, 336 | UBE2E3 | K T T A K L S T S A K R I Q K E L J E I T L D |
| 229, 337 | UBE2U | M H G R A Y L L L H R D F C J L K E N N |
| 230, 338 | UBE2J1 | M E T R Y N L K S P A V K R L M K E A J E L K D P |
| 231, 339 | UBE2J2 | M S S T S S K R A P T T A T Q R L K Q D Y J R I K K D |
| 232, 340 | UBE2N | M A G L P R R I I K E T J R L L A E |
| 233, 341 | UBE2NL | M A E L P H R I I K E T J R L L A E |
| 234, 342 | UBE2T | M Q R A S R L K R E L J M L A T E |
| 235, 343 | UBE2V1 | M A A T T G S G V K V P R N F R L L E E L J E G Q K G |
| 236, 344 | UBE2V2 | M A V S T G V K V P R N F R L L E E L J E G Q K G |
| 237, 345 | UBE2S | M N S N V E N L P P H I I R L V Y K E V J T L T A D |
| 238, 346 | UBE2C | A R G P V G K R L Q Q E L J T L M M S |
| 239, 347 | UBE2W | M A S M Q K R L Q K E L J A L Q N D |
| 240, 348 | UBE2O | A K K F F S T V R K E M J L L A T S |
| 241, 349 | BIRC6 | A N D A N S A A R A R R L A Q E A J T L S T S |
| 242, 350 | UBE2L3 | M A A S R R L M K E L J E I R K C |
| 243, 351 | UBE2L6 | M M A S M R V V K E L J D L Q K K |
| 244, 352 | FTS | G P F Y L E Y S L L A E F J L V V K Q |
| 245, 353 | UBE2Q | G A V S G S V Q A T D R L M K E L J D I Y R S |
| 246, 354 | UBE2Q2 | G A V S G S V Q A S D R L M K E L J D I Y R S |
| 247, 355 | UBE2H | M S S P S P G K R R M D T D V J K L I E S |
| 248, 356 | UBE2A-tr/UBE2B-tr | M S T P A R R R L M R D F J R L Q |
| 249, 357 | UBE2G2-tr | M A G T A L K R L M A E Y J |
| 250, 358 | Ubc4 | M A L K R I N R E L J D L G K D |
| 251, 359 | Ubc15 | M P S S A S E Q L L R K Q L J E I Q K N |
| 827, 830 | Ubc15-tr-m | M P S S A S R Q L L J K Q L K E I Q |
| 828, 831 | Ubc15-tr-m | M P S S A S R Q L L R J Q L K E I Q |
| 829, 832 | Ubc15-tr-m | M P S S A S R Q L L R K Q L J E I Q |

$A_{-11}\ A_{-10}\ A_{-9}\ A_{-8}\ A_{-7}\ A_{-6}\ A_{-5}\ A_{-4}\ A_{-3}\ A_{-2}\ A_{-1}$
$A_1\ A_2\ A_3\ A_4\ A_5\ A_6\ A_7\ A_8\ A_9\ A_{10}\ A_{11}\ A_{12}\ A_{13}\ A_{14}\ A_{15}\ A_{16}$
Consensus Amino Acid Position In certain instances, the above warhead-bearing sequences can be structurally stabilized by any method known in the art or described herein. For example, at least two amino acids (e.g., 2, 3, 4, 5) of the sequence separated by 2, 3, or 6 amino acids can be replaced with non-natural amino acids that can form a staple and/or stitch.

In some embodiments, the stapled, warhead-bearing polypeptide comprises or consists of an amino acid sequence selected from Table 11.

TABLE 11

Exemplary warhead-bearing stapled peptides. SEQ ID NOs: 360-503 and 833-836 (from top to bottom, respectively): "B" is norleucine; "X₁" and "X₂" are non-natural amino acids which can be covalently joined ("stapled together") using a ring-closing metathesis (RCM) reaction to form a cross-linked ring; "J" is a non-natural electrophile containing amino acid or an electrophilic warhead presented in the context of a moiety that is not an amino acid (the electrophile can serve as a chemical cap). SEQ ID NOs: 504-647 and 837-840 (from top to bottom, respectively): "B" is norleucine; "X₁" is R-octenyl alanine, "X₂" is S-pentenyl alanine, and "J" is a non-natural electrophile containing amino acid or an electrophilic warhead presented in the context of a moiety that is not an amino acid (the electrophile can serve as a chemical cap). SEQ ID NOs: 648-791 and 841-844 (from top to bottom, respectively): "B" is norleucine; "X₁" is R-octenyl alanine, "X₂" is S-pentenyl alanine, and "J" is diamino butanoic acid terminating in acrylamide or diamino butanoic acid terminating in bromoacetyl. "tr" = truncated; "m" = mutant

| SEQ ID NOs: | Gene | Sequence |
|---|---|---|
| 360, 504, 648 | UBE2K | B A N I A X1 V Q P I J R X2 F K E V L K S |
| 361, 505, 649 | UBE2A/UBE2B | B S T P A X1 R P R L J R X2 F K R L Q E D |
| 362, 506, 650 | UBE2G1 | B T E L Q X1 A L L L J R X2 L A E L N K N |
| 363, 507, 651 | UBE2G2 | B A G T X1 L K P L J A X2 Y K Q L T L N |
| 364, 508, 652 | UBE2R1 | B A R P L V P S X1 Q K A L J L X2 L K G L Q E E |
| 365, 509, 653 | UBE2R2 | B A Q Q Q B T S X1 Q K A L J L X2 L K S L Q E E |
| 366, 510, 654 | UBE2D1 | B X1 L K R I J K X2 L S D L Q R D |
| 367, 511, 655 | UBE2D2 | B X1 L K R I J K X2 L N D L A R D |
| 368, 512, 656 | UBE2D3 | B X1 L K R I J K X2 L S D L A R D |
| 369, 513, 657 | UBE2D4 | B X1 L K R I J K X2 L T D L Q R D |
| 370, 514, 658 | UBE2E1 | K N S K L L S T X1 A K R I J K X2 L A D I T L D |
| 371, 515, 659 | UBE2E2 | K T A A K L S T X1 A K R I J K X2 L A E I T L D |
| 372, 516, 660 | UBE2E3 | K T T A K L S T X1 A K R I J K X2 L A E I T L D |
| 373, 517, 661 | UBE2U | B H G R A X1 L L L H J D X2 C D L K E N N |
| 374, 518, 662 | UBE2J1 | B E T R Y N L K S P X1 V K R L J K X2 A A E L K D P |
| 375, 519, 663 | UBE2J2 | B S S T S S K R A P T T X1 T Q R L J Q X2 Y L R I K K D |
| 376, 520, 664 | UBE2N | B A G X1 P R R I J K X2 T Q R L L A E |
| 377, 521, 665 | UBE2NL | B A E X1 P H R I J K X2 T Q R L L A E |
| 378, 522, 666 | UBE2T | B Q X1 A S R L J R X2 L H B L A T E |
| 379, 523, 667 | UBE2V1 | B A A T T G S G V K V P X1 N F R L J E X2 L E E G Q K G |
| 380, 524, 668 | UBE2V2 | B A V S T G V K V P X1 N F R L J E X2 L E E G Q K G |
| 381, 525, 669 | UBE2S | B N S N V E N L P P H X1 I R L V J K X2 V T T L T A D |
| 382, 526, 670 | UBE2C | A R G P X1 G K R L J Q X2 L B T L B B S |
| 383, 527, 671 | UBE2W | B A S X1 Q K R L J K X2 L L A L Q N D |
| 384, 528, 672 | UBE2O | A K K X1 F S T V J K X2 B A L L A T S |
| 385, 529, 673 | BIRC6 | A N D A N S A A X1 A R R L J Q X2 A V T L S T S |

TABLE 11-continued

Exemplary warhead-bearing stapled peptides. SEQ ID NOs: 360-503 and

| | | | | |
|---|---|---|---|---|
| 386, | 530, | 674 | UBE2L3 | B A X1 S R R L J K X2 L E E I R K C |
| 387, | 531, | 675 | UBE2L6 | B B X1 S B R V J K X2 L E D L Q K K |
| 388, | 532, | 676 | FTS | G P F Y X1 E Y S L J A X2 F T L V V K Q |
| 389, | 533, | 677 | UBE2Q | G A V S G S V Q X1 T D R L J K X2 L R D I Y R S |
| 390, | 534, | 678 | UBE2Q2 | G A V S G S V Q X1 S D R L J K X2 L R D I Y R S |
| 391, | 535, | 679 | UBE2H | B S S P S P X1 K R R B J T X2 V V K L I E S |
| 392, | 536, | 680 | UBE2A-tr/ UBE2B-tr | B S T P X1 R R R L J R X2 F K R L Q |
| 393, | 537, | 681 | UBE2G2-tr | B A G T X1 L K R L J A X2 Y K |
| 394, | 538, | 682 | Ubc4 | B X1 L K R I J R X2 L A D L G K D |
| 395, | 539, | 683 | Ubc15 | B P S S A X1 E Q L L J K X2 L K E I Q K N |
| 396, | 540, | 684 | UBE2K | B A N I X1 V Q R I K J X2 F K E V L K S |
| 397, | 541, | 685 | UBE2A/ UBE2B | B S T P X1 R R R L B J X2 F K R L Q E D |
| 398, | 542, | 686 | UBE2G1 | B T E L Q X1 A L L L R J X2 L A E L N K N |
| 399, | 543, | 687 | UBE2G2 | B A G T X1 L K R L B J X2 Y K Q L T L N |
| 400, | 544, | 688 | UBE2R1 | B A R P L V P S X1 Q K A L L J X2 L K G L Q E E |
| 401, | 545, | 689 | UBE2R2 | B A Q Q Q B T S X1 Q K A L B J X2 L K S L Q E E |
| 402, | 546, | 690 | UBE2D1 | B X1 L K R I Q J X2 L S D L Q R D |
| 403, | 547, | 691 | UBE2D2 | B X1 L K R I H J X2 L N D L A R D |
| 404, | 548, | 692 | UBE2D3 | B X1 L K R I N J X2 L S D L A R D |
| 405, | 549, | 693 | UBE2D4 | B X1 L K R I Q J X2 L T D L Q R D |
| 406, | 550, | 694 | UBE2E1 | K N S K L L S T X1 A K R I Q J X2 L A D I T L D |
| 407, | 551, | 695 | UBE2E2 | K T A A K L S T X1 A K R I Q J X2 L A E I T L D |
| 408, | 552, | 696 | UBE2E3 | K T T A K L S T X1 A K R I Q J X2 L A E I T L D |
| 409, | 553, | 697 | UBE2U | B H G R A X1 L L L H R J X2 C D L K E N N |
| 410, | 554, | 698 | UBE2J1 | B E T R Y N L K S P X1 V K R L B J X2 A A E L K D P |
| 411, | 555, | 699 | UBE2J2 | B S S T S S K R A P T T X1 T Q R L K J X2 Y L R I K K D |
| 412, | 556, | 700 | UBE2N | B A G X1 P R R I I J X2 T Q R L L A E |
| 413, | 557, | 701 | UBE2NL | B A E X1 P H R I I J X2 T Q R L L A E |
| 414, | 558, | 702 | UBE2T | B Q X1 A S R L K J X2 L H B L A T E |
| 415, | 559, | 703 | UBE2V1 | B A A T T G S G V K V P X1 N F R L L J X2 L E E G Q K G |
| 416, | 560, | 704 | UBE2V2 | B A V S T G V K V P X1 N F R L L J X2 L E E G Q K G |
| 417, | 561, | 705 | UBE2S | B N S N V E N L P P H X1 I R L V Y J X2 V T T L T A D |
| 418, | 562, | 706 | UBE2C | A R G P X1 G K R L Q J X2 L B T L B B S |
| 419, | 563, | 707 | UBE2W | B A S X1 Q K R L Q J X2 L L A L Q N D |
| 420, | 564, | 708 | UBE2O | A K K X1 F S T V R J X2 B A L L A T S |
| 421, | 565, | 709 | BIRC6 | A N D A N S A A X1 A R R L A J X2 A V T L S T S |

TABLE 11-continued

Exemplary warhead-bearing stapled peptides. SEQ ID NOs: 360-503 and

| | | | | |
|---|---|---|---|---|
| 422, | 566, | 710 | UBE2L3 | B A X1 S R R L B J X2 L E E I R K C |
| 423, | 567, | 711 | UBE2L6 | B B X1 S B R V V J X2 L E D L Q K K |
| 424, | 568, | 712 | FTS | G P F Y X1 E Y S L L J X2 F T L V V K Q |
| 425, | 569, | 713 | UBE2Q | G A V S G S V Q X1 T D R L B J X2 L R D I Y R S |
| 426, | 570, | 714 | UBE2Q2 | G A V S G S V Q X1 S D R L B J X2 L R D I Y R S |
| 427, | 571, | 715 | UBE2H | B S S P S P X1 K R R B D J X2 V V K L I E S |
| 428, | 572, | 716 | UBE2A-tr/UBE2B-tr | B S T P X1 R R R L B J X2 F K R L Q |
| 429, | 573, | 717 | UBE2G2-tr | B A G T X1 L K R L B J X2 Y K |
| 430, | 574, | 718 | Ubc4 | B X1 L K R I N J X2 L A D L G K D |
| 431, | 575, | 719 | Ubc15 | B P S S A X1 E Q L L R J X2 L K E I Q K N |
| 432, | 576, | 720 | UBE2K | B A N I X1 V Q R I K R X2 F J E V L K S |
| 433, | 577, | 721 | UBE2A/UBE2B | B S T P X1 R R R L B R X2 F J R L Q E D |
| 434, | 578, | 722 | UBE2G1 | B T E L Q X1 A L L L R R X2 L J E L N K N |
| 435, | 579, | 723 | UBE2G2 | B A G T X1 L K R L B A X2 Y J Q L T L N |
| 436, | 580, | 724 | UBE2R1 | B A R P L V P S X1 Q K A L L L X2 L J G L Q E E |
| 437, | 581, | 725 | UBE2R2 | B A Q Q Q B T S X1 Q K A L B L X2 L J S L Q E E |
| 438, | 582, | 726 | UBE2D1 | B X1 L K R I Q K X2 L J D L Q R D |
| 439, | 583, | 727 | UBE2D2 | B X1 L K R I H K X2 L J D L A R D |
| 440, | 584, | 728 | UBE2D3 | B X1 L K R I N K X2 L J D L A R D |
| 441, | 585, | 729 | UBE2D4 | B X1 L K R I Q K X2 L J D L Q R D |
| 442, | 586, | 730 | UBE2E1 | K N S K L L S T X1 A K R I Q K X2 L J D I T L D |
| 443, | 587, | 731 | UBE2E2 | K T A A K L S T X1 A K R I Q K X2 L J E I T L D |
| 444, | 588, | 732 | UBE2E3 | K T T A K L S T X1 A K R I Q K X2 L J E I T L D |
| 445, | 589, | 733 | UBE2U | B H G R A X1 L L L H R D X2 C J L K E N N |
| 446, | 590, | 734 | UBE2J1 | B E T R Y N L K S P X1 V K R L B K X2 A J E L K D P |
| 447, | 591, | 735 | UBE2J2 | B S S T S S K R A P T T X1 T Q R L K Q X2 Y J R I K K D |
| 448, | 592, | 736 | UBE2N | B A G X1 P R R I I K X2 T J R L L A E |
| 449, | 593, | 737 | UBE2NL | B A E X1 P H R I I K X2 T J R L L A E |
| 450, | 594, | 738 | UBE2T | B Q X1 A S R L K R X2 L J B L A T E |
| 451, | 595, | 739 | UBE2V1 | B A A T T G S G V K V P X1 N F R L L E X2 L J E G Q K G |
| 452, | 596, | 740 | UBE2V2 | B A V S T G V K V P X1 N F R L L E X2 L J E G Q K G |
| 453, | 597, | 741 | UBE2S | B N S N V E N L P P H X1 I R L V Y K X2 V J T L T A D |
| 454, | 598, | 742 | UBE2C | A R G P X1 G K R L Q Q X2 L J T L B B S |
| 455, | 599, | 743 | UBE2W | B A S X1 Q K R L Q K X2 L J A L Q N D |
| 456, | 600, | 744 | UBE2O | A K K X1 F S T V R K X2 B J L L A T S |
| 457, | 601, | 745 | BIRC6 | A N D A N S A A X1 A R R L A Q X2 A J T L S T S |
| 458, | 602, | 746 | UBE2L3 | B A X1 S R R L B K X2 L J E I R K C |

TABLE 11-continued

Exemplary warhead-bearing stapled peptides. SEQ ID NOs: 360-503 and

| | | | |
|---|---|---|---|
| 459, 603, 747 | UBE2L6 | | B B X1 S B R V V K X2 L J D L Q K K |
| 460, 604, 748 | FTS | | G P F Y X1 E Y S L L A X2 F J L V V K Q |
| 461, 605, 749 | UBE2Q | | G A V S G S V Q X1 T D R L B K X2 L J D I Y R S |
| 462, 606, 750 | UBE2Q2 | | G A V S G S V Q X1 S D R L B K X2 L J D I Y R S |
| 463, 607, 751 | UBE2H | | B S S P S P X1 K R R B D T X2 V J K L I E S |
| 464, 608, 752 | UBE2A-tr/UBE2B-tr | | B S T P X1 R R R L B R X2 F J R L Q |
| 465, 609, 753 | UBE2G2-tr | | B A G T X1 L K R L B A X2 Y J |
| 466, 610, 754 | Ubc4 | | B X1 L K R I N R X2 L J D L G K D |
| 467, 611, 755 | Ubc15 | | B P S S A X1 E Q L L R K X2 L J E I Q K N |
| 468, 612, 756 | UBE2K | | B A N X1 A V Q R I K X2 E F J E V L K S |
| 469, 613, 757 | UBE2A/UBE2B | | B S T X1 A R R R L B X2 D F J R L Q E D |
| 470, 614, 758 | UBE2G1 | | B T E L X1 S A L L L R X2 Q L J E L N K N |
| 471, 615, 759 | UBE2G2 | | B A G X1 A L K R L B X2 E Y J Q L T L N |
| 472, 616, 760 | UBE2R1 | | B A R P L V P X1 S Q K A L L X2 E L J G L Q E E |
| 473, 617, 761 | UBE2R2 | | B A Q Q Q B T X1 S Q K A L B X2 E L J S L Q E E |
| 474, 618, 762 | UBE2D1 | | X1 A L K R I Q X2 E L J D L Q R D |
| 475, 619, 763 | UBE2D2 | | X1 A L K R I H X2 E L J D L A R D |
| 476, 620, 764 | UBE2D3 | | X1 A L K R I N X2 E L J D L A R D |
| 477, 621, 765 | UBE2D4 | | X1 A L K R I Q X2 E L J D L Q R D |
| 478, 622, 766 | UBE2E1 | | K N S K L L S X1 S A K R I Q X2 E L J D I T L D |
| 479, 623, 767 | UBE2E2 | | K T A A K L S X1 S A K R I Q X2 E L J E I T L D |
| 480, 624, 768 | UBE2E3 | | K T T A K L S X1 S A K R I Q X2 E L J E I T L D |
| 481, 625, 769 | UBE2U | | B H G R X1 Y L L L H R X2 F C J L K E N N |
| 482, 626, 770 | UBE2J1 | | B E T R Y N L K S X1 A V K R L B X2 E A J E L K D P |
| 483, 627, 771 | UBE2J2 | | B S S T S S K R A P T X1 A T Q R L K X2 D Y J R I K K D |
| 484, 628, 772 | UBE2N | | B A X1 L P R R I I X2 E T J R L L A E |
| 485, 629, 773 | UBE2NL | | B A X1 L P H R I I X2 E T J R L L A E |
| 486, 630, 774 | UBE2T | | B X1 R A S R L K X2 E L J B L A T E |
| 487, 631, 775 | UBE2V1 | | B A A T T G S G V K V X1 R N F R L L X2 E L J E G Q K G |
| 488, 632, 776 | UBE2V2 | | B A V S T G V K V X1 R N F R L L X2 E L J E G Q K G |
| 489, 633, 777 | UBE2S | | B N S N V E N L P P X1 I I R L V Y X2 E V J T L T A D |
| 490, 634, 778 | UBE2C | | A R G X1 V G K R L Q X2 E L J T L B B S |
| 491, 635, 779 | UBE2W | | B A X1 B Q K R L Q X2 E L J A L Q N D |
| 492, 636, 780 | UBE2O | | A K X1 F F S T V R X2 E B J L L A T S |
| 493, 637, 781 | BIRC6 | | A N D A N S A X1 R A R R L A X2 E A J T L S T S |
| 494, 638, 782 | UBE+32 | | B X1 A S R R L B X2 E L J E I R K C |

TABLE 11-continued

Exemplary warhead-bearing stapled peptides. SEQ ID NOs: 360-503 and

| | | | | | | | | | | | | | | | | | | | | | | | | | | | |
|---|---|---|---|---|---|---|---|---|---|---|---|---|---|---|---|---|---|---|---|---|---|---|---|---|---|---|---|
| 495, | 639, | 783 | UBE2L6 | | | | | B | X1 | A | S | B | R | V | V | X2 | E | L | J | D | L | Q | K | K | | | |
| 496, | 640, | 784 | FTS | | | | | G | P | F | X1 | L | E | Y | S | L | L | X2 | E | F | J | L | V | V | K | Q | |
| 497, | 641, | 785 | UBE2Q | | | G | A | V | S | G | S | V | X1 | A | T | D | R | L | B | X2 | E | L | J | D | I | Y | R S |
| 498, | 642, | 786 | UBE2Q2 | | | G | A | V | S | G | S | V | X1 | A | S | D | R | L | B | X2 | E | L | J | D | I | Y | R S |
| 499, | 643, | 787 | UBE2H | | | | | B | S | S | P | S | X1 | G | K | R | R | B | D | X2 | D | V | J | K | L | I | E S |
| 500, | 644, | 788 | UBE2A-tr/UBE2B-tr | | | | | | | B | S | T | X1 | A | R | R | R | L | B | X2 | D | F | J | R | L | Q | |
| 501, | 645, | 789 | UBE2G2-tr | | | | | | | B | A | G | X1 | A | L | K | R | L | B | X2 | E | Y | J | | | |
| 502, | 646, | 790 | Ubc4 | | | | | | | | | | X1 | A | L | K | R | I | N | X2 | E | L | J | D | L | G | K D |
| 503, | 647, | 791 | Ubc15 | | | | | | | B | P | S | S | X1 | S | E | Q | L | L | R | X2 | Q | L | J | E | I | Q K N |
| 833, | 837, | 841 | Ubc15-tr-m | | | | | | | B | P | S | S | X1 | S | R | Q | L | L | R | X2 | Q | L | J | E | I | Q |
| 834, | 838, | 842 | Ubc15-tr-m | | | | | | | B | P | S | S | A | X1 | R | Q | L | L | R | J | X2 | L | K | E | I | Q |
| 835, | 839, | 843 | Ubc15-tr-m | | | | | | | B | P | S | S | A | X1 | R | Q | L | L | J | K | X2 | L | K | E | I | Q |
| 836, | 840, | 844 | Ubc15-tr-m | | | | | | | B | P | S | S | A | X1 | R | Q | I | I | I | R | K | X2 | L | J | E | I Q |

A₋₁₁ A₋₁₀ A₋₉ A₋₈ A₋₇ A₋₆ A₋₅ A₋₄ A₋₃ A₋₂ A₋₁
A₁ A₂ A₃ A₄ A₅ A₆ A₇ A₈ A₉ A1₀ A₁₁ A₁₂ A₁₃ A₁₄ A₁₅ A₁₆
Consensus Amino Acid Position In some embodiments, the warhead-bearing stapled peptide comprises or consists of an amino acid sequence listed above in Table 11, wherein multiple (e.g., 1, 2, 3, 4, 5, 6) residues that do not engage in direct interaction with the E2 hA's cognate E1 enzyme are replaced with residues selected from the group consisting of Ala (alanine), D-Ala (D-alanine), Aib (α-aminoisobutyric acid), Sar (N-methyl glycine), and Ser (serine), other substituted alanine, and a glycine derivative. Additionally, one or more of these residues (e.g., 1, 2, 3, 4, 5, 6) can be appended to the C-terminus of the peptide. In some instances, 0 to 5 amino acids at the C-terminus of the above peptides of Table 11 are replaced with a residue or residues selected from the group consisting of Ala (alanine), D-Ala (D-alanine), Aib (α-aminoisobutyric acid), Sar (N-methyl glycine), and Ser (serine), other substituted alanine, and a glycine derivative.

In some embodiments, the disclosure features a warhead-bearing E2 hA stapled peptide that is at least 14%, at least 15%, at least 20%, at least 27%, at least 34%, at least 40%, at least 47%, at least 50%, at least 53%, at least 60%, at least 65% at least 70%, at least 75%, at least 80%, at least 85%, at least 90%, at least 95%, at least 97%, at least 98%, at least 99%, or 100% identical to the amino acid sequence set forth in Table 10 or 11, and wherein the modified peptide covalently binds UBA1. In some embodiments, these modified peptides have reduced hydrophobicity and/or overall positive charge relative to the stapled E2 hA peptide prior to the amino acid variation. In some embodiments, hydrophobicity or positive charge are independently enhanced to optimize cell penetrance.

In certain embodiments, the disclosure features a warhead-bearing E2 hA stapled peptide that has 1-10 (e.g., 1, 2, 3, 4, 5, 6, 7, 8, 9, or 10) amino acid substitutions relative to the amino acid sequence set forth in Table 10 or 11, and wherein the modified peptide covalently binds UBA1. In some embodiments, these modified peptides have reduced hydrophobicity and/or overall positive charge relative to the stapled E2 hA peptide prior to the amino acid substitution. In some embodiments, hydrophobicity or positive charge are independently enhanced to optimize cell penetrance.

Exemplary Stabilized E2 hA Peptide Variants and Warhead Bearing Stabilized E2 hA Peptide Variants In a specific embodiment, the stabilized peptide is based on the amino acid sequence of SEQ ID NO:4 with 0 to 6 (i.e., 0, 1, 2, 3, 4, 5, 6) amino acid substitutions, insertions, and/or deletions. In a specific embodiment, the stabilized peptide is based on the amino acid sequence of SEQ ID NO:39 with 0 to 6 (i.e., 0, 1, 2, 3, 4, 5, 6) amino acid substitutions, insertions, and/or deletions. In a specific embodiment, the stabilized peptide comprises the amino acid sequence of BSTPX₁RRRLBRX₂FKRLQ, wherein "B" is norleucine, wherein "X₁" is S-pentenyl alanine, and wherein "X2" is R-octenyl alanine (SEQ ID NO:132), with 0 to 6 (i.e., 0, 1, 2, 3, 4, 5, 6) amino acid substitutions, insertions, and/or deletions. In a particular embodiment, the stapled peptide further comprises one or more of the modifications described in the sections "E2 hA Peptides" and "Stabilized Peptides" above. In another embodiment, the stabilized peptide consists of the amino acid sequence of SEQ ID NO:132. In certain embodiments, the zero to six (i.e., 0, 1, 2, 3, 4, 5, 6) amino acids of SEQ ID NO:132 that are substituted by another amino acid are on the E1 non-interacting face of the helix of SEQ ID NO:132. In some embodiments, 0 to 3 amino acids in SEQ ID NO:132 are removed from the C-terminal or are removed and replaced with 1 to 6 amino acids from the group consisting of alanine, D-alanine, α-aminoisobutyric acid, N-methyl glycine, serine, a substituted alanine, and a glycine derivative. In some embodiments, 0 to 6 amino acids on the non-interacting face in SEQ ID NO:132 are substituted with an amino acid selected from the group consisting of alanine, D-alanine, α-aminoisobutyric acid, N-methyl glycine, serine, a substituted alanine, and a glycine derivative. In some embodiments, one or more of the following amino acids Arg-7 (i.e., A4), Leu-9 (i.e., A6), norleucine-10 (i.e., A7), Phe-13 (i.e., A10), and optionally Leu-16 (i.e., A13), of SEQ ID NO:132 are substituted with an alpha-methylated or alpha-ethylated natural amino acids. In some embodiments, one or more of the following amino acids Arg-7 (i.e., A4), Leu-9 (i.e., A6), norleucine-10 (i.e., A7), Phe-13 (i.e., A10), and optionally Leu-16 (i.e., A13), of SEQ ID NO:132 are substituted with an amino acid selected from the group consisting of L-alanine, D-alanine, α-aminoisobutyric acid, N-methyl glycine, serine, a substituted alanine, and a glycine derivative. In some embodiments, one or more of the following amino acids norleucine-1 (i.e., A−3), Ser-2 (i.e., A−2), Thr-3 (i.e., A−1), Pro-4 (i.e., A1), Ala-5 (i.e., A2), Arg-6 (i.e., A3), Arg-8 (i.e., A5), Arg-11 (i.e., A8), Asp-12 (i.e., A9), Lys-14 (i.e., A11), Arg-15 (i.e., A12), and Gln-17 (i.e., A14) of SEQ ID NO:132 are substituted with an alpha-methylated or alpha-ethylated natural amino acids. In certain embodiments, one or more of the following amino acids norleucine-1 (i.e., A−3), Ser-2 (i.e., A−2), Thr-3 (i.e., A−1), Pro-4 (i.e., A1), Ala-5 (i.e., A2), Arg-6 (i.e., A3), Arg-8 (i.e., A5), Arg-11 (i.e., A8), Asp-12 (i.e., A9), Lys-14 (i.e., A11), Arg-15 (i.e., A12), and Gln-17 (i.e., A14) of SEQ ID NO:132 are substituted with an amino acid selected from the group consisting of L-alanine, D-alanine, α-aminoisobutyric acid, N-methyl glycine, serine, a substituted alanine, and a glycine derivative. In certain instances, the one to six amino acids of SEQ ID NO:132 that are substituted by another amino acid are on the E1 interacting face of the helix of SEQ ID NO:132. In other instances, the one to six amino acids of SEQ ID NO:132 that are substituted by another amino acid are on the E1 non-interacting and interacting faces of the helix of SEQ ID NO:132. In certain embodiments, the one to six amino acids of SEQ ID NO:132 are substituted by an amino acid or amino acids selected from the group consisting of L-alanine, D-alanine, α-aminoisobutyric acid, N-methyl glycine, serine, a substituted alanine, and a glycine derivative.

In a specific embodiment, the stabilized peptide is based on the amino acid sequence of SEQ ID NO:6 with 0 to 6 (i.e., 0, 1, 2, 3, 4, 5, 6) amino acid substitutions, insertions, and/or deletions. In a specific embodiment, the stabilized peptide is based on the amino acid sequence of SEQ ID NO:55 with 0 to 6 (i.e., 0, 1, 2, 3, 4, 5, 6) amino acid substitutions, insertions, and/or deletions. In a specific embodiment, the stabilized peptide comprises the amino acid sequence of BAGTX$_1$LKRLBAX$_2$YK, wherein "B" is norleucine, wherein "X$_1$" is S-pentenyl alanine, and wherein "X2" is R-octenyl alanine (SEQ ID NO:133), with 0 to 6 (i.e., 0, 1, 2, 3, 4, 5, 6) amino acid substitutions, insertions, and/or deletions. In a particular embodiment, the stapled peptide further comprises one or more of the modifications described in the sections "E2 hA Peptides" and "Stabilized Peptides" above. In another embodiment, the stabilized peptide consists of the amino acid sequence of SEQ ID NO:133. In certain embodiments, the zero to six (i.e., 0, 1, 2, 3, 4, 5, 6) amino acids of SEQ ID NO:133 that are substituted by another amino acid are on the E1 non-interacting face of the helix of SEQ ID NO:133. In some embodiments, 0 to 3 amino acids in SEQ ID NO:133 are removed from the C-terminal or are removed and replaced with 1 to 6 amino acids from the group consisting of alanine, D-alanine, α-aminoisobutyric acid, N-methyl glycine, serine, a substituted alanine, and a glycine derivative. In some embodiments, 0 to 6 amino acids on the non-interacting face in SEQ ID NO:133 are substituted with an amino acid selected from the group consisting of alanine, D-alanine, α-aminoisobutyric acid, N-methyl glycine, serine, a substituted alanine, and a glycine derivative. In some embodiments, one or more of the following amino acids Lys-7 (i.e., A4), Leu-9 (i.e., A6), norleucine-10 (i.e., A7), Tyr-13 (i.e., A10), and optionally Leu-16 (i.e., A13), of SEQ ID NO:133 are substituted with an alpha-methylated or alpha-ethylated natural amino acids. In some embodiments, one or more of the following amino acids Lys-7 (i.e., A4), Leu-9 (i.e., A6), norleucine-10 (i.e., A7), Tyr-13 (i.e., A10), and optionally Leu-16 (i.e., A13), of SEQ ID NO:133 are substituted with an amino acid selected from the group consisting of L-alanine, D-alanine, α-aminoisobutyric acid, N-methyl glycine, serine, a substituted alanine, and a glycine derivative. In some embodiments, one or more of the following amino acids norleucine-1 (i.e., A−3), Ala-2 (i.e., A−2), Gly-3 (i.e., A−1), Thr-4 (i.e., A1), Ala-5 (i.e., A2), Leu-6 (i.e., A3), Arg-7 (i.e., A5), Ala-10 (i.e., A8), Glu-11 (i.e., A9), and Lys-13 (i.e., A11) of SEQ ID NO:133 are substituted with an alpha-methylated or alpha-ethylated natural amino acids. In certain embodiments, one or more of the following amino acids norleucine-1 (i.e., A−3), Ala-2 (i.e., A−2), Gly-3 (i.e., A−1), Thr-4 (i.e., A1), Ala-5 (i.e., A2), Leu-6 (i.e., A3), Arg-7 (i.e., A5), Ala-10 (i.e., A8), Glu-11 (i.e., A9), and Lys-13 (i.e., A11) of SEQ ID NO:107 are substituted with an amino acid selected from the group consisting of L-alanine, D-alanine, α-aminoisobutyric acid, N-methyl glycine, serine, a substituted alanine, and a glycine derivative. In certain instances, the one to six amino acids of SEQ ID NO:133 that are substituted by another amino acid are on the E1 interacting face of the helix of SEQ ID NO:133. In other instances, the one to six amino acids of SEQ ID NO:133 that are substituted by another amino acid are on the E1 non-interacting and interacting faces of the helix of SEQ ID NO:133. In certain embodiments, the one to six amino acids of SEQ ID NO:133 are substituted by an amino acid or amino acids selected from the group consisting of L-alanine, D-alanine, α-aminoisobutyric acid, N-methyl glycine, serine, a substituted alanine, and a glycine derivative.

In a specific embodiment, the stabilized peptide is based on the amino acid sequence of SEQ ID NO:10 with 0 to 6 (i.e., 0, 1, 2, 3, 4, 5, 6) amino acid substitutions, insertions, and/or deletions. In a specific embodiment, the stabilized peptide comprises the amino acid sequence of BX$_1$LKRIHKX$_2$LNDLARD, wherein "B" is norleucine, wherein "X$_1$" is S-pentenyl alanine, and wherein "X$_2$" is R-octenyl alanine (SEQ ID NO:107), with 0 to 6 (i.e., 0, 1, 2, 3, 4, 5, 6) amino acid substitutions, insertions, and/or deletions. In a particular embodiment, the stapled peptide further comprises one or more of the modifications described in the sections "E2 hA Peptides" and "Stabilized Peptides" above. In another embodiment, the stabilized peptide consists of the amino acid sequence of SEQ ID NO:107. In certain embodiments, the zero to six (i.e., 0, 1, 2, 3, 4, 5, 6) amino acids of SEQ ID NO:107 that are substituted by another amino acid are on the E1 non-interacting face of the helix of SEQ ID NO:107. In some embodiments, 0 to 3 amino acids in SEQ ID NO:107 are removed from the C-terminal or are removed and replaced with 1 to 6 amino acids from the group consisting of alanine, D-alanine, α-aminoisobutyric acid, N-methyl glycine, serine, a substituted alanine, and a glycine derivative. In some embodiments, 0 to 6 amino acids on the non-interacting face in SEQ ID NO:107 are substituted with an amino acid selected from the group consisting of alanine, D-alanine, α-aminoisobutyric acid, N-methyl glycine, serine, a substituted alanine, and a glycine derivative. In some embodiments, one or more of the following amino acids Lys-4 (i.e., A4), Ile-6 (i.e., A6), His-7 (i.e., A7), Leu-10 (i.e., A10), and optionally Leu-13 (i.e., A13), of SEQ ID NO:107 are substituted with an alpha-methylated or alpha-ethylated natural amino acids. In some embodiments, one or more of the following amino acids Lys-4 (i.e., A4), Ile-6 (i.e., A6), His-7 (i.e., A7), Leu-10 (i.e., A10), and optionally Leu-13 (i.e., A13), of SEQ ID NO:107 are substituted with an amino acid selected from the group consisting of L-alanine, D-alanine, α-aminoisobutyric acid, N-methyl glycine, serine, a substituted alanine, and a glycine derivative. In some embodiments, one or more of the following amino acids norleucine-1 (i.e., A1), Ala-2 (i.e., A2), Leu-3 (i.e., A3), Arg-5 (i.e., A5), Lys-8 (i.e., A8), Glu-9 (i.e., A9), Asn-11 (i.e., A11), Asp-12 (i.e., A12), Ala-14 (i.e., A14), Arg-15 (i.e., A15), and Asp-16 (i.e., A16) of SEQ ID NO:107 are substituted with an alpha-methylated or alpha-ethylated natural amino acids. In certain embodiments, one or more of the following amino acids norleucine-1 (i.e., A1), Ala-2 (i.e., A2), Leu-3 (i.e., A3), Arg-5 (i.e., A5), Lys-8 (i.e., A8), Glu-9 (i.e., A9), Asn-11 (i.e., A11), Asp-12 (i.e., A12), Ala-14 (i.e., A14), Arg-15 (i.e., A15), and Asp-16 (i.e., A16) of SEQ ID NO:107 are substituted with an amino acid selected from the group consisting of L-alanine, D-alanine, α-aminoisobutyric acid, N-methyl glycine, serine, a substituted alanine, and a glycine derivative. In certain instances, the one to six amino acids of SEQ ID NO:107 that are substituted by another amino acid are on the E1 interacting face of the helix of SEQ ID NO:107. In other instances, the one to six amino acids of SEQ ID NO:107 that are substituted by another amino acid are on the E1 non-interacting and interacting faces of the helix of SEQ ID NO:107. In certain embodiments, the one to six amino acids of SEQ ID NO:107 are substituted by an amino acid or amino acids selected from the group consisting of L-alanine, D-alanine, α-aminoisobutyric acid, N-methyl glycine, serine, a substituted alanine, and a glycine derivative.

In another specific embodiment, the peptide is an E1-binding warhead-bearing E2 hA peptide described herein. For example, the peptides of SEQ ID NOs: 4, 6, 10, 39, 55, or their variants described above, are modified to include a non-natural electrophile contain substitutions, insertions, and/or deletions (as described above). In a particular embodiment, the E1-binding warhead-bearing E2 hA peptide comprises the sequence of SEQ ID NO:429 with 0 to 6 (i.e., 0, 1, 2, 3, 4, 5, 6) amino acid substitutions, insertions, and/or deletions (as described above). In another particular embodiment, the E1-binding warhead-bearing E2 hA peptide comprises the sequence of SEQ ID NO:717 with 0 to 6 (i.e., 0, 1, 2, 3, 4, 5, 6) amino acid substitutions, insertions, and/or deletions (as described above). In a particular embodiment, the E1-binding warhead-bearing E2 hA peptide (e.g., SEQ ID NO:213, 429, or 717) further comprises one or more of the modifications described in the sections "E2 hA Peptides" and "Stabilized Peptides" above.

In a specific embodiment, the E1-binding warhead-bearing E2 hA peptide comprises the sequence of SEQ ID NO:249 with 0 to 6 (i.e., 0, 1, 2, 3, 4, 5, 6) amino acid substitutions, insertions, and/or deletions (as described above). In a particular embodiment, the E1-binding warhead-bearing E2 hA peptide comprises the sequence of SEQ ID NO:465 with 0 to 6 (i.e., 0, 1, 2, 3, 4, 5, 6) amino acid substitutions, insertions, and/or deletions (as described above). In another particular embodiment, the E1-binding warhead-bearing E2 hA peptide comprises the sequence of SEQ ID NO:753 with 0 to 6 (i.e., 0, 1, 2, 3, 4, 5, 6) amino acid substitutions, insertions, and/or deletions (as described above). In a particular embodiment, the E1-binding warhead-bearing E2 hA peptide comprises the sequence of SEQ ID NO:501 with 0 to 6 (i.e., 0, 1, 2, 3, 4, 5, 6) amino acid substitutions, insertions, and/or deletions (as described above). In another particular embodiment, the E1-binding warhead-bearing E2 hA peptide comprises the sequence of SEQ ID NO:789 with 0 to 6 (i.e., 0, 1, 2, 3, 4, 5, 6) amino acid substitutions, insertions, and/or deletions (as described above). In a particular embodiment, the E1-binding warhead-bearing E2 hA peptide (e.g., SEQ ID NO:249, 465, 501, 753, or 789) further comprises one or more of the modifications described in the sections "E2 hA Peptides" and "Stabilized Peptides" above.

In a specific embodiment, the E1-binding warhead-bearing E2 hA peptide comprises the sequence of SEQ ID NO:151 with 0 to 6 (i.e., 0, 1, 2, 3, 4, 5, 6) amino acid substitutions, insertions, and/or deletions (as described above). In a particular embodiment, the E1-binding warhead-bearing E2 hA peptide comprises the sequence of SEQ ID NO:367 with 0 to 6 (i.e., 0, 1, 2, 3, 4, 5, 6) amino acid substitutions, insertions, and/or deletions (as described above). In another particular embodiment, the E1-binding warhead-bearing E2 hA peptide comprises the sequence of SEQ ID NO:655 with 0 to 6 (i.e., 0, 1, 2, 3, 4, 5, 6) amino acid substitutions, insertions, and/or deletions (as described above). In a particular embodiment, the E1-binding warhead-bearing E2 hA peptide (e.g., SEQ ID NO:151, 367, or 655) further comprises one or more of the modifications described in the sections "E2 hA Peptides" and "Stabilized Peptides" above.

In a specific embodiment, the E1-binding warhead-bearing E2 hA peptide comprises the sequence of SEQ ID NO:187 with 0 to 6 (i.e., 0, 1, 2, 3, 4, 5, 6) amino acid substitutions, insertions, and/or deletions (as described above). In a particular embodiment, the E1-binding warhead-bearing E2 hA peptide comprises the sequence of SEQ ID NO:403 with 0 to 6 (i.e., 0, 1, 2, 3, 4, 5, 6) amino acid substitutions, insertions, and/or deletions (as described above). In another particular embodiment, the E1-binding warhead-bearing E2 hA peptide comprises the sequence of SEQ ID NO:691 with 0 to 6 (i.e., 0, 1, 2, 3, 4, 5, 6) amino acid substitutions, insertions, and/or deletions (as described above). In a particular embodiment, the E1-binding warhead-bearing E2 hA peptide (e.g., SEQ ID NO:187, 403, or 691) further comprises one or more of the modifications described in the sections "E2 hA Peptides" and "Stabilized Peptides" above.

In a specific embodiment, the E1-binding warhead-bearing E2 hA peptide comprises the sequence of SEQ ID NO:223 with 0 to 6 (i.e., 0, 1, 2, 3, 4, 5, 6) amino acid substitutions, insertions, and/or deletions (as described above). In a particular embodiment, the E1-binding warhead-bearing E2 hA peptide comprises the sequence of SEQ ID NO:439 with 0 to 6 (i.e., 0, 1, 2, 3, 4, 5, 6) amino acid substitutions, insertions, and/or deletions (as described above). In another particular embodiment, the E1-binding warhead-bearing E2 hA peptide comprises the sequence of SEQ ID NO:727 with 0 to 6 (i.e., 0, 1, 2, 3, 4, 5, 6) amino acid substitutions, insertions, and/or deletions (as described above). In a particular embodiment, the E1-binding warhead-bearing E2 hA peptide comprises the sequence of SEQ ID NO:475 with 0 to 6 (i.e., 0, 1, 2, 3, 4, 5, 6) amino acid substitutions, insertions, and/or deletions (as described above). In another particular embodiment, the E1-binding warhead-bearing E2 hA peptide comprises the sequence of SEQ ID NO:763 with 0 to 6 (i.e., 0, 1, 2, 3, 4, 5, 6) amino acid substitutions, insertions, and/or deletions (as described above). In a particular embodiment, the E1-binding warhead-bearing E2 hA peptide (e.g., SEQ ID NO:223, 439, 727, 757, or 763) further comprises one or more of the modifications described in the sections "E2 hA Peptides" and "Stabilized Peptides" above.

In a specific embodiment, the E1-binding warhead-bearing E2 hA peptide comprises the sequence of SEQ ID NO:827 with 0 to 6 (i.e., 0, 1, 2, 3, 4, 5, 6) amino acid substitutions, insertions, and/or deletions (as described above). In a particular embodiment, the E1-binding warhead-bearing E2 hA peptide comprises the sequence of SEQ ID NO:835 with 0 to 6 (i.e., 0, 1, 2, 3, 4, 5, 6) amino acid substitutions, insertions, and/or deletions (as described above). In another particular embodiment, the E1-binding warhead-bearing E2 hA peptide comprises the sequence of SEQ ID NO:843 with 0 to 6 (i.e., 0, 1, 2, 3, 4, 5, 6) amino acid substitutions, insertions, and/or deletions (as described above). In a particular embodiment, the E1-binding warhead-bearing E2 hA peptide (e.g., SEQ ID NO:827, 835, or 843) further comprises one or more of the modifications described in the sections "E2 hA Peptides" and "Stabilized Peptides" above.

In a specific embodiment, the E1-binding warhead-bearing E2 hA peptide comprises the sequence of SEQ ID NO:828 with 0 to 6 (i.e., 0, 1, 2, 3, 4, 5, 6) amino acid substitutions, insertions, and/or deletions (as described above). In a particular embodiment, the E1-binding warhead-bearing E2 hA peptide comprises the sequence of SEQ ID NO:834 with 0 to 6 (i.e., 0, 1, 2, 3, 4, 5, 6) amino acid substitutions, insertions, and/or deletions (as described above). In another particular embodiment, the E1-binding warhead-bearing E2 hA peptide comprises the sequence of SEQ ID NO:842 with 0 to 6 (i.e., 0, 1, 2, 3, 4, 5, 6) amino acid substitutions, insertions, and/or deletions (as described above). In a particular embodiment, the E1-binding warhead-bearing E2 hA peptide (e.g., SEQ ID NO:828, 834, or 842) further comprises one or more of the modifications described in the sections "E2 hA Peptides" and "Stabilized Peptides" above.

In a specific embodiment, the E1-binding warhead-bearing E2 hA peptide comprises the sequence of SEQ ID NO:829 with 0 to 6 (i.e., 0, 1, 2, 3, 4, 5, 6) amino acid substitutions, insertions, and/or deletions (as described above). In a particular embodiment, the E1-binding warhead-bearing E2 hA peptide comprises the sequence of SEQ ID NO:836 with 0 to 6 (i.e., 0, 1, 2, 3, 4, 5, 6) amino acid substitutions, insertions, and/or deletions (as described above). In another particular embodiment, the E1-binding warhead-bearing E2 hA peptide comprises the sequence of SEQ ID NO:844 with 0 to 6 (i.e., 0, 1, 2, 3, 4, 5, 6) amino acid substitutions, insertions, and/or deletions (as described above). In a particular embodiment, the E1-binding warhead-bearing E2 hA peptide comprises the sequence of SEQ ID NO:833 with 0 to 6 (i.e., 0, 1, 2, 3, 4, 5, 6) amino acid substitutions, insertions, and/or deletions (as described above). In another particular embodiment, the E1-binding warhead-bearing E2 hA peptide comprises the sequence of SEQ ID NO:841 with 0 to 6 (i.e., 0, 1, 2, 3, 4, 5, 6) amino acid substitutions, insertions, and/or deletions (as described above). In a particular embodiment, the E1-binding warhead-bearing E2 hA peptide (e.g., SEQ ID NO:829, 833, 836, 841, or 844) further comprises one or more of the modifications described in the sections "E2 hA Peptides" and "Stabilized Peptides" above.

Methods of Treatment

The disclosure features methods of using any of the stabilized peptides (or pharmaceutical compositions comprising said stabilized peptides) described herein for the prophylaxis and/or treatment of an E1-expressing or E1-dependent disease. Nonlimiting examples of E1-expressing or E1-dependent diseases include cancer, hematological malignancies, solid tumors, antibody-mediated transplant rejection, autoimmune disorders, inflammatory disorders, and other diseases of pathologic cell survival. The terms "treat" or "treating," as used herein, refers to alleviating, inhibiting, or ameliorating the disease or condition from which the subject is suffering.

The peptides (or compositions comprising the peptides) described herein can be useful for treating a human subject with an E1-expressing cancer. The peptides (or compositions comprising the peptides) described herein can also be useful for treating a human subject with an E1-dependent cancer. In certain embodiments, the cancer is a solid tumor or a liquid tumor. In certain embodiments, the solid tumor is a bladder cancer tumor, a bile duct cancer tumor, a bone cancer tumor, a soft tissue sarcoma, a brain tumor, a spinal cord tumor, a breast cancer tumor, a pancreatic cancer tumor, a colorectal cancer tumor, a rectal cancer tumor, a small intestine cancer tumor, a prostate cancer tumor, a kidney cancer tumor, a hepatocellular cancer tumor, a gallbladder cancer tumor, a lung cancer tumor, a bronchial cancer tumor, a ovarian cancer tumor, a cervical cancer tumor, a vaginal cancer tumor, a endometrial cancer tumor, a gastric cancer tumor, a esophageal cancer tumor, a head and neck cancer (e.g., nasopharyngeal, oropharyngeal, salivary gland, and thyroid cancer) tumor, a melanoma tumor, an ocular melanoma tumor, or a neuroendocrine tumor. In certain embodiments, the cancer is a melanoma, a leukemia, lymphoma, or other hematologic malignancy or solid tumor. In certain embodiments, the hematologic malignancy is acute myeloid leukemia, acute lymphoblastic leukemia, chronic myeloid leukemia, chronic lymphocytic leukemia, myelodysplastic syndrome, multiple myeloma, chronic myelogenous leukemia, chronic myelomonocytic leukemia, a lymphoma (e.g., Hodgkin's disease, follicular lymphoma, mantle cell lymphoma, B-cell lymphoma, diffuse large B-Cell lymphoma, and T-cell lymphoma), a myeloproliferative syndrome, or Waldenstrom's macroglobulinemia. In certain embodiments, the cancer is a breast cancer, an autonomic ganglia cancer, a pancreatic cancer, a skin cancer, a CNS cancer, a hematopoietic or lymphoid cancer, a lung cancer, a large intestine cancer, a stomach cancer, a soft tissue sarcoma, or a bone cancer. In certain instances, the solid tumor is a melanoma, a breast cancer or a lung cancer. In certain embodiments, the autoimmune or inflammatory disorder is a gastrointestinal disorder (e.g., celiac disease, Crohn's disease, or ulcerative colitis), a skin and musculoskeletal condition (e.g., alopecia areata, scleroderma, psoriasis, pemphigoid, rheumatoid arthritis, osteoarthritis, psoriatic arthritis, fibromyalgia, polymyalgia rheumatica, ankylosing spondylitis, Behcet's disease, CREST syndrome, lupus erythematosus, or vitiligo), an airway and pulmonary disease (e.g., asthma or COPD), an autoimmune neuropathy (e.g., chronic inflammatory demyelinating polyneuropathy, acute motor axonal neuropathy, multiple sclerosis, or restless leg syndrome), vasculitis, nephritis, hepatitis, biliary cirrhosis, primary sclerosing cholangitis, myocarditis, Addison's disease, antiphospholipid syndrome, aplastic anemia, encephalitis, chronic fatigue syndrome, diabetes mellitus, endometriosis, Graves' disease, Guillain-Barre syndrome, sarcoidosis, infection-associated inflammation, ischemia-associated inflammation, or a neurodegenerative disorder (e.g., Alzheimer's disease).

In certain embodiments, the human subject in need thereof is administered a peptide selected from the group consisting of the sequences of Tables 7, 8, and 11-15. In certain embodiments, the human subject in need thereof is administered a stapled E2 hA peptide comprising or consisting of SEQ ID NO:4 or a modified version thereof, e.g., a peptide comprising or consisting of the amino acid sequence of any one of SEQ ID NOs:65, 96, 101, and 132. In certain embodiments, the human subject in need thereof is administered a stapled E2 hA peptide comprising or consisting of SEQ ID NO:6 or a modified version thereof e.g., a peptide comprising or consisting of the amino acid sequence of any one of SEQ ID NOs:67, 97, 103, and 133. In certain embodiments, the human subject in need thereof is administered a stapled E2 hA peptide comprising or consisting of SEQ ID NO:10, or a modified version thereof e.g., a peptide comprising or consisting of the amino acid sequence of SEQ ID NO:71 or SEQ ID NO:107. In certain embodiments, the human subject in need thereof is administered a stapled E2 hA peptide comprising or consisting of SEQ ID NO:2, or a modified version thereof e.g., a peptide comprising or consisting of the amino acid sequence of SEQ ID NO:99, 135, 850, and 851.

In certain embodiments, the human subject in need thereof is administered a warhead-bearing peptide selected from the group consisting of the sequences of Tables 10 and 14. In certain embodiments, the human subject in need thereof is administered a warhead-bearing stapled peptide based on SEQ ID NO:4, e.g., a peptide comprising or consisting of the amino acid sequence of SEQ ID NOs: 361, 392, 397, 428, 433, 464, 469, 500, 505, 536, 541, 572, 577, 608, 613, 644, 649, 680, 685, 716, 721, 752, 757, and 788. In certain embodiments, the human subject in need thereof is administered a warhead-bearing stapled peptide based on SEQ ID NO:6, e.g., a peptide comprising or consisting of the amino acid sequence of SEQ ID NOs: 363, 393, 399, 429, 435, 465, 471, 501, 507, 537, 543, 573, 579, 609, 615, 645, 651, 681, 687, 717, 723, 753, 759, and 789. In certain embodiments, the human subject in need thereof is administered a warhead-bearing stapled peptide based on SEQ ID NO:10, e.g., a peptide comprising or consisting of the amino acid sequence of SEQ ID NOs: 367, 403, 439, 475, 511, 547, 583, 619, 655, 691, 727, and 763. In certain embodiments, the human subject in need thereof is administered a warhead-bearing stapled peptide based on SEQ ID NO:2, e.g., a peptide comprising or consisting of the amino acid sequence of SEQ ID NOs: 395, 431, 467, 502, 503, 539, 575, 611, 646, 647, 683, 719, 755, 790, 791, and 833-844. In certain embodiments, the human subject in need thereof is administered a peptide that is at least 14%, at least 15%, at least 20%, at least 27%, at least 34%, at least 40%, at least 47%, at least 50%, at least 53%, at least 60%, at least 65% at least 70%, at least 75%, at least 80%, at least 85%, at least 90%, at least 95%, at least 96%, at least 97%, at least 98%, at least 99%, or 100% identical to an amino acid sequence of selected from the group consisting of the sequences of Tables 10 and 14.

In some instances for the treatment of cancer, an autoimmune disorder, or an inflammatory disorder, the human subject in need thereof is co-administered with radiotherapy, immunotherapy, or chemotherapy. Nonlimiting examples of chemotherapies include alkylating agents (e.g., busulfan, carboplatin, carmustine, chlorambucil, cisplatin, cyclophosphamide, dacarbazine, ifosfamide, lomustine, mephelan, oxaliplatin, procarbazine hydrochloride, temozolomide, or thiotepa), antimetabolites (e.g., azathioprine, capecitibine, cladrabine, clofarabine, cytarabine, decitabine, floxuradine, fluorouracil, hydrozyurea, mercaptopurine, methotrexate, pralatrexate, thioguanine, pentostatin, or vidarabine), antitumor antibiotics (e.g., dactinomycin, bleomycin, mitomycin C, adriamycin, daunorubicin, idarubicin, doxorubicin, or mitoxantrone), mitotic inhibitors (e.g., paclitaxel, docetaxel, vinorelbine, vincristine, vinblastine), platinum agents (e.g., cisplatin, carboplatin, or oxaliplatin), proteasome inhibitors (e.g., bortezomib), topoisomerase inhibitors (e.g., etoposide, teniposide, camptothecin, topotecan, irinotecan, doxorubicin, or daunorubicin), thalidomide and related analogs, steroids (e.g., dexamethasone or prednisone), and antibodies (e.g., trastuzumab, rituximab, cetuximab, and bevacizumab). In some instances, the human subject in need thereof is co-administered with an immunomodulatory agent or an anti-inflammatory agent. Nonlimiting examples of immunomodulatory agents include methothrexate, leflunomide, cyclophosphamide, cyclosporine A, mycophenolate mofetil, rapamycin, mizoribine, deoxyspergualin, and brequinar. Nonlimiting examples of anti-inflammatory agents include non-steroidal anti-inflammatory drugs (e.g., salicylic acid, acetylsalicylic acid, methyl salicylate, diflunisal, salsalate, olsalazine, sulfasalazine, acetaminophen, indomethacin, sulindac, etodolac, mefenamic acid, meclofenamate sodium, tolmetin, ketorolac, dichlofenac, ibuprofen, naproxen, naproxen sodium, fenoprofen, ketoprofen, flurbinprofen, oxaprozin, piroxicam, meloxicam, ampiroxicam, droxicam, pivoxicam, tenoxicam, nabumetome, phenylbutazone, oxyphenbutazone, antipyrine, aminopyrine, apazone and nimesulide; leukotriene antagonists including zileuton, aurothioglucose, gold sodium thiomalate or auranofin), steroids (e.g., alclometasone diproprionate, amcinonide, beclomethasone dipropionate, betametasone, betamethasone benzoate, betamethasone diprorionate, betamethasone sodium phosphate, betamethasone valerate, clobetasol proprionate, clocortolone pivalate, hydrocortisone, hydrocortisone derivatives, desonide, desoximatasone, dexamethasone, flunisolide, flucoxinolide, flurandrenolide, halcinocide, medrysone, methylprednisolone, methprednisolone acetate, methylprednisolone sodium succinate, mometasone furoate, paramethasone acetate, prednisolone, prednisolone acetate, prednisolone sodium phosphate, prednisolone tebuatate, prednisone, triamcinolone, triamcinolone acetonide, triamcinolone diacetate, or triamcinolone hexacetonide); and other anti-inflammatory agents (e.g., methotrexate, colchicine, allopurinol, probenecid, sulfinpyrazone or benzbromarone).

In some embodiments, the human subject has a cancer, a hematological malignancy, a solid tumor, an antibody-mediated transplant rejection, an autoimmune disorder, or an inflammatory disorder.

In general, methods include selecting a subject and administering to the subject an effective amount of one or more of the peptides herein, e.g., in or as a pharmaceutical composition, and optionally repeating administration as required for the prophylaxis or treatment of a cancer and can be administered orally, intravenously or topically. A subject can be selected for treatment based on, e.g., determining that the subject has a cancer that expresses E1. The peptides of this disclosure can be used to determine if a subject's cancer expresses E1, or if a subject's cancer is dependent on E1.

Specific dosage and treatment regimens for any particular patient will depend upon a variety of factors, including the activity of the specific compound employed, the age, body weight, general health status, sex, diet, time of administration, rate of excretion, drug combination, the severity and course of the disease, condition or symptoms, the patient's disposition to the disease, condition or symptoms, and the judgment of the treating physician.

An effective amount can be administered in one or more administrations, applications or dosages. A therapeutically effective amount of a therapeutic compound (i.e., an effective dosage) depends on the therapeutic compounds selected. The compositions can be administered one from one or more times per day to one or more times per week; including once every other day. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of the therapeutic compounds described herein can include a single treatment or a series of treatments. For example, effective amounts can be administered at least once.

Pharmaceutical Compositions

One or more of any of the stabilized peptides described herein can be formulated for use as or in pharmaceutical compositions. The pharmaceutical compositions may be used in the methods of treatment described herein (see above). In certain embodiments, the pharmaceutical composition comprises a peptide comprising or consisting of an amino acid sequence that is identical to an amino acid sequence set forth in any one of Tables 7-14, except for 1 to 10, 1 to 9, 1 to 8, 1 to 7, 1 to 6, 1 to 5, 1 to 4, 1 to 3, 1 to 2, or 1 amino acid substitution, insertion, or deletion. These changes to the amino acid sequences can be made on the E1 non-interacting alpha-helical face of these peptides (i.e., to the amino acids that do not engage/are predicted to not engage in direct interaction with the E1) and/or on the E1 interacting alpha-helical face (i.e., to the amino acids that directly interact/are predicted to directly interact with the E1). Such compositions can be formulated or adapted for administration to a subject via any route, e.g., any route approved by the Food and Drug Administration (FDA). Exemplary methods are described in the FDA's CDER Data Standards Manual, version number 004 (which is available at fda.give/cder/dsm/DRG/drg00301.htm). For example, compositions can be formulated or adapted for administration by inhalation (e.g., oral and/or nasal inhalation (e.g., via nebulizer or spray)), injection (e.g., intravenously, intra-arterial, subdermally, intraperitoneally, intramuscularly, and/or subcutaneously); and/or for oral administration, transmucosal adminstration, and/or topical administration (including topical (e.g., nasal) sprays and/or solutions).

In some instances, pharmaceutical compositions can include an effective amount of one or more stabilized peptides. The terms "effective amount" and "effective to treat," as used herein, refer to an amount or a concentration of one or more compounds or a pharmaceutical composition described herein utilized for a period of time (including acute or chronic administration and periodic or continuous administration) that is effective within the context of its administration for causing an intended effect or physiological outcome (e.g., treatment of infection).

Pharmaceutical compositions of this invention can include one or more peptides and any pharmaceutically acceptable carrier and/or vehicle. In some instances, pharmaceuticals can further include one or more additional therapeutic agents in amounts effective for achieving a modulation of disease or disease symptoms. For example, the pharmaceutical composition may include a radiotherapeutic agent, an immunotherapeutic agent, a chemotherapeutic agent, an immunomodulatory agent, or an anti-inflammatory agent.

The term "pharmaceutically acceptable carrier or adjuvant" refers to a carrier or adjuvant that may be administered to a patient, together with a compound of this invention, and which does not destroy the pharmacological activity thereof and is nontoxic when administered in doses sufficient to deliver a therapeutic amount of the compound.

Pharmaceutically acceptable carriers, adjuvants and vehicles that may be used in the pharmaceutical compositions of this invention include, but are not limited to, ion exchangers, alumina, aluminum stearate, lecithin, self-emulsifying drug delivery systems (SEDDS) such as d-α-tocopherol polyethyleneglycol 1000 succinate, surfactants used in pharmaceutical dosage forms such as Tweens or other similar polymeric delivery matrices, serum proteins, such as human serum albumin, buffer substances such as phosphates, glycine, sorbic acid, potassium sorbate, partial glyceride mixtures of saturated vegetable fatty acids, water, salts or electrolytes, such as protamine sulfate, disodium hydrogen phosphate, potassium hydrogen phosphate, sodium chloride, zinc salts, colloidal silica, magnesium trisilicate, polyvinyl pyrrolidone, cellulose-based substances, polyethylene glycol, sodium carboxymethylcellulose, polyacrylates, waxes, polyethylene-polyoxypropylene-block polymers, polyethylene glycol and wool fat. Cyclodextrins such as α-, β-, and γ-cyclodextrin, may also be advantageously used to enhance delivery of compounds of the formulae described herein.

The pharmaceutical compositions of this invention may contain any conventional non-toxic pharmaceutically-acceptable carriers, adjuvants or vehicles. In some cases, the pH of the formulation may be adjusted with pharmaceutically acceptable acids, bases or buffers to enhance the stability of the formulated compound or its delivery form. The term parenteral as used herein includes subcutaneous, intra-cutaneous, intra-venous, intra-muscular, intra-articular, intra-arterial, intra-synovial, intra-sternal, intra-thecal, intra-lesional and intra-cranial injection or infusion techniques.

Pharmaceutical compositions can be in the form of a solution or powder for inhalation and/or nasal administration. Such compositions may be formulated according to techniques known in the art using suitable dispersing or wetting agents (such as, for example, Tween 80) and suspending agents. The sterile injectable preparation may also be a sterile injectable solution or suspension in a non-toxic parenterally acceptable diluent or solvent, for example, as a solution in 1,3-butanediol. Among the acceptable vehicles and solvents that may be employed are mannitol, water, Ringer's solution and isotonic sodium chloride solution. In addition, sterile, fixed oils are conventionally employed as a solvent or suspending medium. For this purpose, any bland fixed oil may be employed including synthetic mono- or diglycerides. Fatty acids, such as oleic acid and its glyceride derivatives are useful in the preparation of injectables, as are natural pharmaceutically-acceptable oils, such as olive oil or castor oil, especially in their polyoxyethylated versions. These oil solutions or suspensions may also contain a long-chain alcohol diluent or dispersant, or carboxymethyl cellulose or similar dispersing agents which are commonly used in the formulation of pharmaceutically acceptable dosage forms such as emulsions and or suspensions. Other commonly used surfactants such as Tweens or Spans and/or other similar emulsifying agents or bioavailability enhancers which are commonly used in the manufacture of pharmaceutically acceptable solid, liquid, or other dosage forms may also be used for the purposes of formulation.

Pharmaceutical compositions can be orally administered in any orally acceptable dosage form including, but not limited to, capsules, tablets, emulsions and aqueous suspensions, dispersions and solutions. In the case of tablets for oral use, carriers which are commonly used include lactose and corn starch. Lubricating agents, such as magnesium stearate, are also typically added. For oral administration in a capsule form, useful diluents include lactose and dried corn starch. When aqueous suspensions and/or emulsions are administered orally, the active ingredient may be suspended or dissolved in an oily phase is combined with emulsifying and/or suspending agents. If desired, certain sweetening and/or flavoring and/or coloring agents may be added.

Alternatively or in addition, pharmaceutical compositions can be administered by nasal aerosol or inhalation. Such compositions are prepared according to techniques well-known in the art of pharmaceutical formulation and may be prepared as solutions in saline, employing benzyl alcohol or other suitable preservatives, absorption promoters to enhance bioavailability, fluorocarbons, and/or other solubilizing or dispersing agents known in the art.

In some instances, one or more peptides disclosed herein can be conjugated, for example, to a carrier protein. Such conjugated compositions can be monovalent or multivalent. For example, conjugated compositions can include one peptide disclosed herein conjugated to a carrier protein. Alternatively, conjugated compositions can include two or more peptides disclosed herein conjugated to a carrier.

As used herein, when two entities are "conjugated" to one another they are linked by a direct or indirect covalent or non-covalent interaction. In certain embodiments, the association is covalent. In other embodiments, the association is non-covalent. Non-covalent interactions include hydrogen bonding, van der Waals interactions, hydrophobic interactions, magnetic interactions, electrostatic interactions, etc. An indirect covalent interaction is when two entities are covalently connected, optionally through a linker group.

Carrier proteins can include any protein that increases or enhances immunogenicity in a subject. Exemplary carrier proteins are described in the art (see, e.g., Fattom et al., *Infect. Immun.*, 58:2309-2312, 1990; Devi et al., *Proc. Natl. Acad. Sci. USA* 88:7175-7179, 1991; Li et al., *Infect. Immun.*

57:3823-3827, 1989; Szu et al., *Infect. Immun.* 59:4555-4561,1991; Szu et al., *J. Exp. Med.* 166:1510-1524, 1987; and Szu et al., *Infect. Immun.* 62:4440-4444, 1994). Polymeric carriers can be a natural or a synthetic material containing one or more primary and/or secondary amino groups, azido groups, or carboxyl groups. Carriers can be water soluble.

Methods of Making Stabilized Peptides

This disclosure features methods of making stabilized (e.g., single stapled, double stapled, or stitched) peptides. The method involves providing a un-crosslinked version of any of the peptides described herein comprising two or more non-natural amino acids and cross-linking the peptide. In one instance, the cross-linking is by ring closing metathesis (RCM) reaction.

Stapled peptide synthesis: Fmoc-based solid-phase peptide synthesis can be used to synthesize stapled peptide fusion inhibitors in accordance with reported methods for generating all-hydrocarbon stapled peptides. For example, to achieve the various staple lengths, α-methyl, α-alkenyl amino acids were installed at i, i+4 (or i, i+7) positions using, e.g., two S-2-(4'-pentenyl) alanine (S5) residues; two (R)-2-(((9H-fluoren-9-yl)methoxy)carbonylamino)-2-methyl-dec-9-enoic acid ($R_8$) residues; or one S5 residue and one S8 residue. In some instances, to achieve the various staple lengths, α-methyl, α-alkenyl amino acids were installed at i, i+4 (or i, and i+7) positions using e.g., R-octenyl alanine (e.g., (R)-α-(7'-octenyl)alanine); R-pentenyl alanine (e.g., (R)-α-(4'-pentenyl)alanine); one bis-pentenyl glycine (e.g., α,α-Bis(4'-pentenyl)glycine); one one bis-octenyl glycine (e.g., α,α-Bis(7'-octenyl)glycine); or S-octenyl alanine (e.g., (S)-α-(7'-octenyl)alanine). For the stapling reaction, Grubbs 1st generation ruthenium catalyst dissolved in dichloroethane is added to the resin-bound peptides. To ensure maximal conversion, three to five rounds of stapling are performed. The peptides are then cleaved off of the resin using trifluoroacetic acid, precipitated using a hexane:ether (1:1) mixture, air dried, and purified by LC-MS. The peptides can be quantified by amino acid analysis.

Stitched peptide synthesis: Methods of synthesizing the stitched peptides are known in the art. Nevertheless, the following exemplary method may be used. Synthetic chemistry transformations and protecting group methodologies (protection and deprotection) useful in synthesizing the compounds described herein are known in the art and include, for example, those such as described in R. Larock, Comprehensive Organic Transformations, VCH Publishers (1989); T. W. Greene and P. G. M. Wuts, Protective Groups in Organic Synthesis, 3d. Ed., John Wiley and Sons (1999); L. Fieser and M. Fieser, Fieser and Fieser's Reagents for Organic Synthesis, John Wiley and Sons (1994); and L. Paquette, ed., Encyclopedia of Reagents for Organic Synthesis, John Wiley and Sons (1995), and subsequent editions thereof.

The peptides of this invention can be made by chemical synthesis methods, which are well known to the ordinarily skilled artisan. See, for example, Fields et al., Chapter 3 in Synthetic Peptides: A User's Guide, ed. Grant, W. H. Freeman & Co., New York, N.Y., 1992, p. 77. Hence, peptides can be synthesized using the automated Merrifield techniques of solid phase synthesis with the α-$NH_2$ protected by either t-Boc or Fmoc chemistry using side chain protected amino acids on, for example, an Applied Biosystems Peptide Synthesizer Model 430A or 431.

One manner of making of the peptides described herein is using solid phase peptide synthesis (SPPS). The C-terminal amino acid is attached to a cross-linked polystyrene resin via an acid labile bond with a linker molecule. This resin is insoluble in the solvents used for synthesis, making it relatively simple and fast to wash away excess reagents and by-products. The N-terminus is protected with the Fmoc group, which is stable in acid, but removable by base. Any side chain functional groups are protected with base stable, acid labile groups.

Longer peptides could be made by conjoining individual synthetic peptides using native chemical ligation. Insertion of a stitching amino acid may be performed as described in, e.g., Young and Schultz, *J Biol Chem.* 2010 Apr. 9; 285(15): 11039-11044. Alternatively, the longer synthetic peptides can be synthesized by well-known recombinant DNA techniques. Such techniques are provided in well-known standard manuals with detailed protocols. To construct a gene encoding a peptide of this invention, the amino acid sequence is reverse translated to obtain a nucleic acid sequence encoding the amino acid sequence, preferably with codons that are optimum for the organism in which the gene is to be expressed. Next, a synthetic gene is made, typically by synthesizing oligonucleotides which encode the peptide and any regulatory elements, if necessary. The synthetic gene is inserted in a suitable cloning vector and transfected into a host cell. The peptide is then expressed under suitable conditions appropriate for the selected expression system and host. The peptide is purified and characterized by standard methods.

The peptides can be made in a high-throughput, combinatorial fashion, e.g., using a high-throughput multiple channel combinatorial synthesizer available from, e.g., Advanced Chemtech or Symphony X. Peptide bonds can be replaced, e.g., to increase physiological stability of the peptide, by: a retro-inverso bonds (C(O)—NH); a reduced amide bond (NH—CH2); a thiomethylene bond (S—CH2 or CH2-S); an oxomethylene bond (O—CH2 or CH2-O); an ethylene bond (CH2-CH2); a thioamide bond (C(S)—NH); a trans-olefin bond (CH=CH); a fluoro substituted trans-olefin bond (CF=CH); a ketomethylene bond (C(O)—CHR) or CHR—C(O) wherein R is H or CH3; and a fluoro-ketomethylene bond (C(O)—CFR or CFR—C(O) wherein R is H or F or CH3.

The peptides can be further modified by: acetylation, amidation, biotinylation, cinnamoylation, farnesylation, fluoresceination, formylation, myristoylation, palmitoylation, phosphorylation (Ser, Tyr or Thr), stearoylation, succinylation and sulfurylation. As indicated above, peptides can be conjugated to, for example, polyethylene glycol (PEG); alkyl groups (e.g., C1-C20 straight or branched alkyl groups); fatty acid radicals; and combinations thereof α,α-Disubstituted non-natural amino acids containing olefinic side chains of varying length can be synthesized by known methods (Williams et al. *J. Am. Chem. Soc.*, 113:9276, 1991; Schafmeister et al., *J. Am. Chem Soc.*, 122:5891, 2000; and Bird et al., *Methods Enzymol.*, 446:369, 2008; Bird et al, *Current Protocols in Chemical Biology*, 2011). In some instances for peptides where an i linked to i+7, i+7 linked to i+14 stitch is used (four turns of the helix stabilized): one R-octenyl alanine (e.g., (R)-α-(7'-octenyl)alanine), one one bis-pentenyl glycine (e.g., α,α-Bis(4'-pentenyl)glycine), and one R-octenyl alanine (e.g., (R)-α-(7'-octenyl)alanine) is used. In some instances for peptides where an i linked to i+7, i+7 linked to i+14 stitch is used (four turns of the helix stabilized): one S-octenyl alanine (e.g., (S)-α-(7'-octenyl) alanine), one one bis-pentenyl glycine (e.g., α,α-Bis(4'-pentenyl)glycine), and one R-octenyl alanine (e.g., (R)-α-(7'-octenyl)alanine) is used. In some instances for peptides where an i linked to i+7, i+7 linked to i+14 stitch is used (four turns of the helix stabilized): one S-octenyl alanine (e.g., (S)-α-(7'-octenyl)alanine), one bis-pentenyl glycine (e.g., α,α-Bis(4'-pentenyl)glycine), and one S-octenyl alanine (e.g., (S)-α-(7'-octenyl)alanine) is used. In some instances for peptides where an i linked to i+7, i+7 linked to i+14 stitch is used (four turns of the helix stabilized): one R-pentenyl alanine (e.g., (R)-α-(4'-pentenyl)alanine), one bis-octenyl glycine (e.g., α,α-Bis(7'-octenyl)glycine), and one S-pentenyl alanine (e.g., (S)-α-(4'-pentenyl)alanine) is used. In some instances for peptides where an i linked to i+7, i+7 linked to i+14 stitch is used (four turns of the helix stabilized): one R-pentenyl alanine (e.g., (R)-α-(4'-pentenyl) alanine), one bis-octenyl glycine (e.g., α,α-Bis(7'-octenyl) glycine), and one R-pentenyl alanine (e.g., (R)-α-(4'-pentenyl)alanine) is used. In some instances for peptides where an i linked to i+7, i+7 linked to i+14 stitch is used (four turns of the helix stabilized): one S-pentenyl alanine (e.g., (S)-α-(4'-pentenyl)alanine), one bis-octenyl glycine (e.g., α,α-Bis (7'-octenyl)glycine), and one R-pentenyl alanine (e.g., (R)-α-(4'-pentenyl)alanine) is used. In some instances for peptides where an i linked to i+7, i+7 linked to i+14 stitch is used (four turns of the helix stabilized): one S-pentenyl alanine (e.g., (S)-α-(4'-pentenyl)alanine), one bis-octenyl glycine (e.g., α,α-Bis(7'-octenyl)glycine), and one S-pentenyl alanine (e.g., (S)-α-(4'-pentenyl)alanine) is used. R-octenyl alanine is synthesized using the same route, except that the starting chiral auxiliary confers the R-alkyl-stereoisomer. Also, 8-iodooctene is used in place of 5-iodopentene. Inhibitors are synthesized on a solid support using solid-phase peptide synthesis (SPPS) on MBHA resin (see, e.g., WO 2010/148335).

Fmoc-protected α-amino acids (other than the olefinic amino acids N-Fmoc-α,α-Bis(4'-pentenyl)glycine, (S)—N-Fmoc-α-(4'-pentenyl)alanine, (R)—N-Fmoc-α-(7'-octenyl) alanine, (R)—N-Fmoc-α-(7'-octenyl)alanine, and (R)—N-Fmoc-α-(4'-pentenyl)alanine), 2-(6-chloro-1-H-benzotriazole-1-yl)-1,1,3,3-tetramethylaminium hexafluorophosphate (HCTU), and Rink Amide MBHA are commercially available from, e.g., Novabiochem (San Diego, CA). Dimethylformamide (DMF), N-methyl-2-pyrrolidinone (NMP), N,N-diisopropylethylamine (DIEA), trifluoroacetic acid (TFA), 1,2-dichloroethane (DCE), fluorescein isothiocyanate (FITC), and piperidine are commercially available from, e.g., Sigma-Aldrich. Olefinic amino acid synthesis is reported in the art (Williams et al., Org. Synth., 80:31, 2003).

Again, methods suitable for obtaining (e.g., synthesizing), stitching, and purifying the peptides disclosed herein are also known in the art (see, e.g., Bird et. al., Methods in Enzymol., 446:369-386 (2008); Bird et al, Current Protocols in Chemical Biology, 2011; Walensky et al., Science, 305: 1466-1470 (2004); Schafmeister et al., J. Am. Chem. Soc., 122:5891-5892 (2000); U.S. patent application Ser. No. 12/525,123, filed Mar. 18, 2010; and U.S. Pat. No. 7,723, 468, issued May 25, 2010, each of which are hereby incorporated by reference in their entirety).

In some instances, the peptides are substantially free of non-stitched peptide contaminants or are isolated. Methods for purifying peptides include, for example, synthesizing the peptide on a solid-phase support. Following cyclization, the solid-phase support may be isolated and suspended in a solution of a solvent such as DMSO, DMSO/dichloromethane mixture, or DMSO/NMP mixture. The DMSO/dichloromethane or DMSO/NMP mixture may comprise about 30%, 40%, 50% or 60% DMSO. In a specific instance, a 50%/50% DMSO/NMP solution is used. The solution may be incubated for a period of 1, 6, 12 or 24 hours, following which the resin may be washed, for example with dichloromethane or NMP. In one instance, the resin is washed with NMP. Shaking and bubbling an inert gas into the solution may be performed.

Properties of the stitched or stapled peptides of the disclosure can be assayed, for example, using the methods described below and in the Examples.

EXAMPLES

The following examples are provided to better illustrate the claimed invention and are not to be interpreted as limiting the scope of the invention. To the extent that specific materials are mentioned, it is merely for purposes of illustration and is not intended to limit the invention. One skilled in the art can develop equivalent means or reactants without the exercise of inventive capacity and without departing from the scope of the invention.

Example 1: Preparation of S. pombe E2 hA Stapled Peptides

In the ubiquitin system, the interaction between E1 and E2 buries 3000 Å$^2$ of protein surface area, 1000 Å$^2$ of which is buried in the interface between helix A of the E2 (E2 hA) and the E1 ubiquitin fold domain (E1 UFD). The Kd of the E1-E2 interaction is in the sub-to-single-digit nanomolar range, and E2 hA accounts for at least 40% of the binding energy of that interaction. Furthermore, the interaction between E1 and E2 hA is important in the formation of the E1-E2 encounter complex. Therefore, stabilized alpha-helical peptides mimicking E2 hA that can act as competitive inhibitors of the E1-E2 interaction, preventing E1 from charging E2, and thus representing a novel mechanism of inhibiting E1 activity, were designed and prepared.

A crystal structure of Ubc15 binding to S. pombe Ube1 (PDB ID: 5KNL) provided the structural bases of UBA1-inhibitor peptide design (FIG. 1A). Structurally-stabilized alpha-helical E2-related peptides were prepared by substituting non-natural amino acids with olefinic side chains at [i, i+4] or [i, i+7] positions in peptides having a modified sequence of the S. pombe Ubc15 helix A (hA), comprising an E7R amino acid substitution. The E7R amino acid substitution has been shown to result in an ~80-fold decrease in $K_m$ (Lv et al., 2017, Molecular Cell, 65(4):699-714). Table 12 provides sequences of the prepared peptides. FIGS. 1B and 1C illustrate a wheel depiction of the peptide portion of SEQ ID NO:40 expected to be alpha helical and depicts the [i, i+4] (FIG. 1B) and [i, i+7] (FIG. 1C) amino acid staple positions introduced into SEQ ID NO:40 to generate the stapled peptides of SEQ ID NOs:41-54 (Table 12, below).

TABLE 12

E2 hA peptides. "B" is norleucine, "$X_1$" is R-octenyl alanine, and "$X_2$" is S-pentenyl alanine.

| SEQ ID NO: | Sequence | FIG. 1B Staple ID | Consensus Numbering Staple Position |
|---|---|---|---|
| 40 | BPSSASRQLLRKQLKEIQ | N/A (no staple) | N/A (no staple) |
| 41 | BPSS$\mathbf{X}_2$SRQ$\mathbf{X}_2$LRKQLKEIQ | 2 | $A_1$ and $A_5$ |
| 42 | BPSSA$\mathbf{X}_2$RQL$\mathbf{X}_2$RKQLKEIQ | 3 | $A_2$ and $A_6$ |
| 43 | BPSSASR$\mathbf{X}_2$LLR$\mathbf{X}_2$QLKEIQ | 4 | $A_4$ and $A_8$ |
| 44 | BPSSASRQ$\mathbf{X}_2$LRK$\mathbf{X}_2$LKEIQ | 5 | $A_5$ and $A_9$ |
| 45 | BPSSASRQL$\mathbf{X}_2$RKQ$\mathbf{X}_2$KEIQ | 6 | $A_6$ and $A_{10}$ |
| 46 | BPSSASRQLLR$\mathbf{X}_2$QLK$\mathbf{X}_2$IQ | 7 | $A_8$ and $A_{12}$ |
| 47 | BPSSASRQLLRK$\mathbf{X}_2$LKE$\mathbf{X}_2$Q | 8 | $A_9$ and $A_{13}$ |
| 48 | BPSSASRQLLRKQ$\mathbf{X}_2$KEI$\mathbf{X}_2$ | 9 | $A_{10}$ and $A_{14}$ |
| 49 | BPSS$\mathbf{X}_1$SRQLLR$\mathbf{X}_2$QLKEIQ | 10 | $A_1$ and $A_8$ |
| 50 | BPSSA$\mathbf{X}_1$RQLLRK$\mathbf{X}_2$LKEIQ | 11 | $A_2$ and $A_9$ |
| 51 | BPSSAS$\mathbf{X}_1$QLLRKQ$\mathbf{X}_2$KEIQ | 12 | $A_3$ and $A_{10}$ |
| 52 | BPSSASR$\mathbf{X}_1$LLRKQL$\mathbf{X}_2$EIQ | 13 | $A_4$ and $A_{11}$ |
| 53 | BPSSASRQ$\mathbf{X}_1$LRKQLK$\mathbf{X}_2$IQ | 14 | $A_5$ and $A_{12}$ |
| 54 | BPSSASRQL$\mathbf{X}_1$RKQLKE$\mathbf{X}_2$Q | 15 | $A_6$ and $A_{13}$ |

The ability of the E2 hA stapled peptides (SEQ ID NOs:41-54) to inhibit E1-mediated ubiquitin transfer to E2 was evaluated. Human E1 activating enzyme UBA1 (10 nM), UbcH5b E2 enzyme (150 nM), ubiquitin (1 μM), and Mg-ATP (20 μM) were combined in the presence of 100 μM E2hA unstapled control peptide (SEQ ID NO:40), stapled peptide (any one of SEQ ID NOs:41-54), or vehicle control (1% DMSO) for 45 minutes at room temperature in buffer containing 50 mM NaCl, 50 mM HEPES, 1 mM TCEP pH 7.5. Control reaction included no E1 enzyme. Reactions were quenched by addition of SDS-containing loading dye and samples were resolved on a 4-12% Bis-Tris protein gel under nonreducing conditions. Proteins were visualized via silver stain. Conjugation of ubiquitin to E2 by E1 was monitored by conversion of free E2 (17 kDa) to E2~ubiquitin conjugate (26 kDa).

The peptide comprising a staple at amino acid positions $A_2$ and $A_9$ (SEQ ID NO:50) was the best in this panel at inhibiting E1-mediated ubiquitin transfer to E2 (FIG. 2). The peptides comprising staples at amino acid positions $A_5$ and $A_9$ (SEQ ID NO:44), $A_8$ and $A_{12}$ (SEQ ID NO:46), $A_9$ and $A_{13}$ (SEQ ID NO:47), $A_1$ and $A_8$ (SEQ ID NO:49), $A_4$ and $A_{11}$ (SEQ ID NO:52), and $A_5$ and $A_{12}$ (SEQ ID NO:53) also inhibited conversion of E2 to E2~ubiquitin by E1 (FIG. 2).

This study revealed that not all of the staple positions introduced into the *S. pombe* Ubc15 E2 hA peptide inhibited E1-mediated ubiquitin transfer to E2. Without being bound by any particular theory, it is hypothesized that peptides comprising staples at positions $A_1$ and $A_5$ (SEQ ID NO:41), $A_2$ and $A_6$ (SEQ ID NO:42), $A_4$ and $A_8$ (SEQ ID NO:43), $A_6$ and $A_{10}$ (SEQ ID NO:45), $A_{10}$ and $A_{14}$ (SEQ ID NO:48), $A_3$ and $A_{10}$ (SEQ ID NO:51), and $A_6$ and $A_{13}$ (SEQ ID NO:54) were unable to inhibit E1-mediated ubiquitin transfer to E2 because introduction of the staple interfered with the E2/E1 binding interface or blocked important residues of the E2 helix A peptide.

Example 2: Preparation of *H. sapiens* E2 hA Stapled Peptides

Given the potent inhibition of E1-mediated ubiquitin transfer to E2 by the *S. pombe* Ubc15 E2hA peptide comprising a staple at positions $A_2$ and $A_9$ (SEQ ID NO:50) and the high homology between the E1 of humans and *S. pombe*, E2 hA stapled peptides were designed and generated based on human E2 hA sequences. Table 2, above, provides the sequences for the E2 hAs encoded by 32 different human genes. Peptides comprising the E2 hA of UBE2D2 or a truncated form of the E2 hA of UBE2G2 or UBE2A with staples at positions $A_2$ and $A_9$, (peptides "SAH-UBE2G2-11", "SAH-UBED2-11", and "SAH-UBE2A-11", respectively; see Table 13; see also FIG. 3, which provides a depiction of the helical wheel portion of these peptides) were generated.

TABLE 13

Stapled E2 hA peptides. "B" is norleucine, wherein "$X_1$" is R-octenyl alanine, and wherein "$X_2$" is S-pentenyl alanine.

| Name | Sequence | SEQ ID NO |
|---|---|---|
| SAH-UBE2G2-11 | BAGTX$_1$LKRLBAX$_2$YK | 133 |
| SAH-UBED2-11 | BX$_1$LKRIHKX$_2$LNDLARD | 107 |
| SAH-UBE2A-11 | BSTPX$_1$RRRLBRX$_2$FKRLQ | 132 |

Figure 4A:
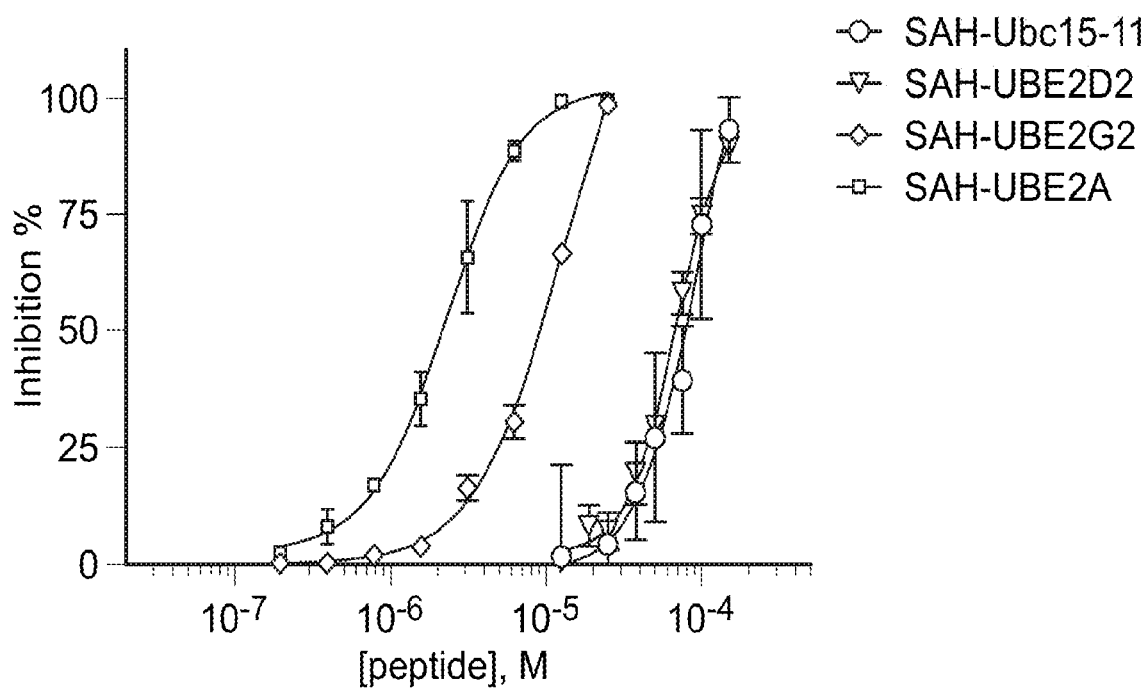
FIGS. 4A and 4B show that stapled peptides SAH-Ubc15-11 (SEQ ID NO:50), SAH-UBE2G2-11 (SEQ ID NO:133), SAH-UBE2D2-11 (SEQ ID NO:107) and SAH-UBE2A-11 (SEQ ID NO:132) dose-dependently inhibit E1-mediated thioester transfer to E2, with the indicated range of potency.
Figure 4B:
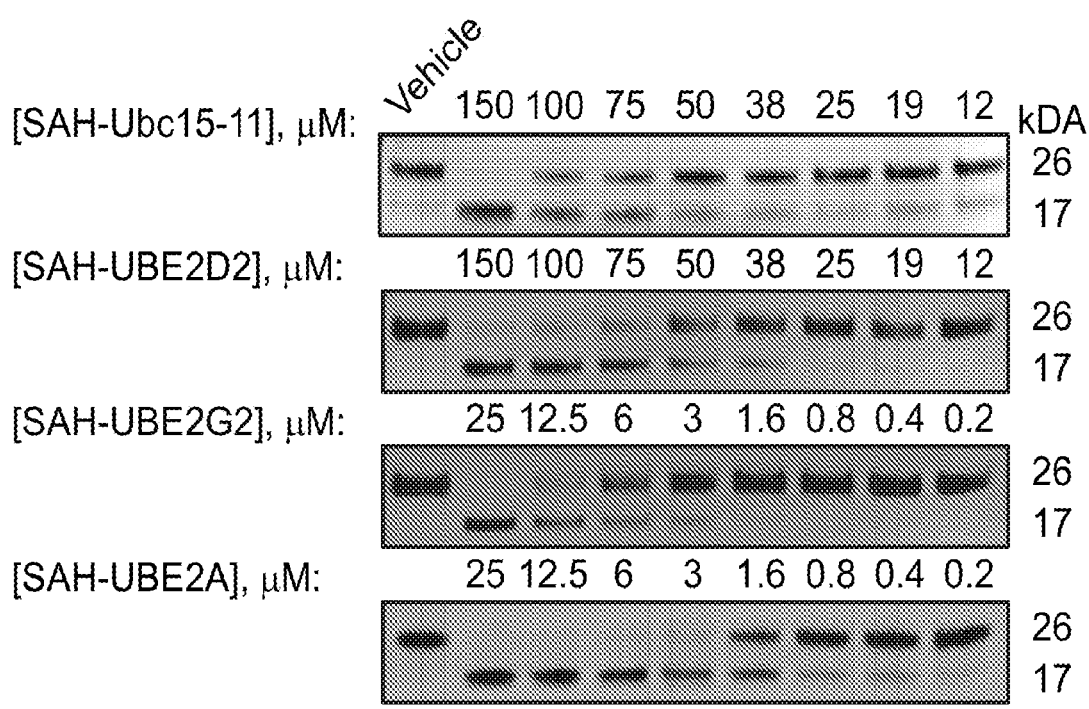

The ability of the peptides to inhibit E1-mediated thioester transfer to E2 was evaluated. Human E1 activating enzyme UBA1 (10 nM), UbcH5b E2 enzyme (150 nM), ubiquitin (1 μM), and Mg-ATP (20 μM) were combined in the presence of stapled peptide at a range of concentrations or vehicle control (1% DMSO) for 45 minutes at room temperature in buffer containing 50 mM NaCl, 50 mM HEPES, 1 mM TCEP pH 7.5. Reactions were quenched by addition of SDS-containing loading dye and samples were resolved on a 4-12% Bis-Tris protein gel under nonreducing conditions. Proteins were visualized via silver stain. Conjugation of ubiquitin to E2 by E1 was monitored by conversion of free E2 (17 kDa) to E2~ubiquitin conjugate (26 kDa). Inhibition percentage was calculated from densitometry of silver stain images. Each of stapled peptides SAH-Ubc15-11 (SEQ ID NO:50), SAH-UBE2G2-11 (SEQ ID NO:133), SAH-UBE2D2-11 (SEQ ID NO:107), and SAH-UBE2A-11 (SEQ ID NO:132) inhibited E1-mediated thioester transfer to E2 in a dose-dependent manner (FIG. 4), with SAH-UBE2A-11 having the most potent activity.

Figure 5:
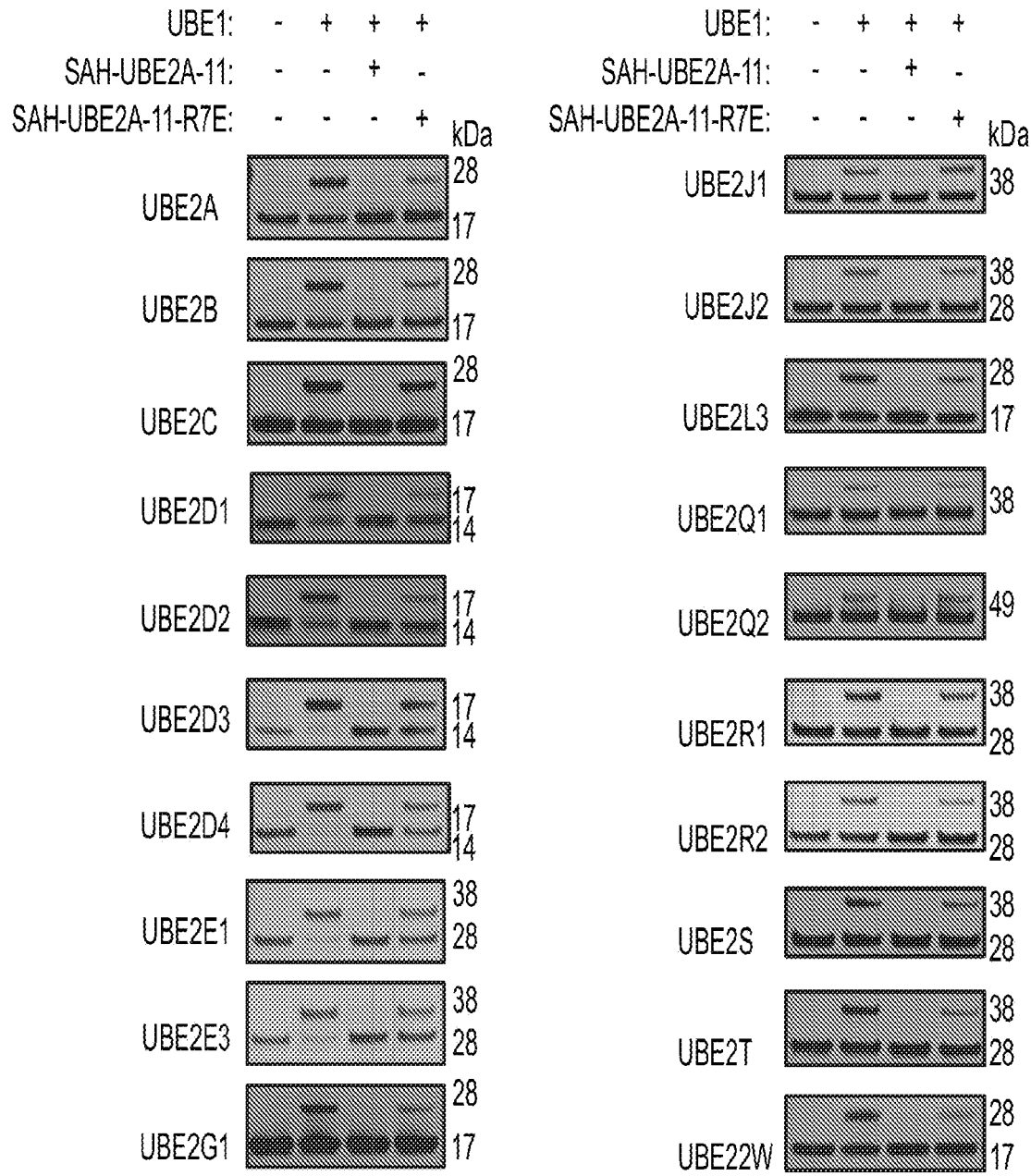
FIG. 5 shows silver staining of in vitro thioester transfer inhibition assay samples run on Bis-Tris protein gels under nonreducing conditions. In vitro thioester transfer inhibition assays were performed with a broad diversity of recombinant human E1 activating protein UBA1, E2 enzyme, ubiquitin, Mg-ATP, and SAH-UBE2A-11 stapled peptide (SEQ ID NO:132) or SAH-UBE2A-11-R7E mutant control stapled peptide (BSTPX₁RERLBRX₂FKRLQ (SEQ ID NO:1338), "X₁" is S-pentenyl alanine, and "X₂" is R-octenyl alanine). Free E2 is visualized at 17 kDa; E2~ubiquitin conjugate is visualized at ~26 kDa. In each case, SAH-UBE2A-11 inhibits E1 thioester transfer activity, which is mitigated by a single point mutation (R7E), highlighting the sequence-specificity of the E1-inhibitory activity.

Example 3: E2 hA Stapled Peptides are Pan-Active Inhibitors of E1-E2 Interactions of the Ubiquitin Pathway Given the potency of SAH-UBE2A-11 (SEQ ID NO:132), this peptide was selected for further evaluation. Humans encode at least 33 human E2 enzymes that are activated by the human E1 enzyme UBA1. To test the pan-inhibitory activity of SAH-UBE2A-11 (SEQ ID NO:132), an in vitro enzyme inhibition was performed using human E1 activating enzyme UBA1, SAH-UBE2A-11 or point mutant negative control SAH-UBE2A-11-R$_7$E (BSTPX$_1$RERLBRX$_2$FKRLQ, "$X_1$" is S-pentenyl alanine, and "X2" is R-octenyl alanine; SEQ ID NO:852), and a variety of different human E2 enzymes (UBE2A, UBE2B, UBE2C, UBE2D1, UBE2D2, UBE2D3, UBE2D4, UBE2E1, UBE2E3, UBE2G1, UBE2L3, UBE2J1, UBE2J2, UBE2R$_1$, UBE2R$_2$, UBE2S, UBE2T, UBE3Q1, UBE2Q1, and UBE2W2). SAH-UBE2A-11 inhibited E1-mediated thioester transfer to all human E2 enzymes tested while the point mutant control SAH-UBE2A-11-R$_7$E had diminished inhibitory capacity, highlighting the specificity of action (FIG. 5). These studies revealed that SAH-UBE2A-11 is pan-active in its ability to inhibit E1-mediated thioester transfer to E2: SAH-UBE2A-11 not only inhibits transfer to the E2 from which it is derived (i.e., UBE2A), but also inhibits transfer to a multitude of other human E2 enzymes.

Example 4: Identification of Key Binding Residues in SAH-UBE2A-11

Figure 6C:
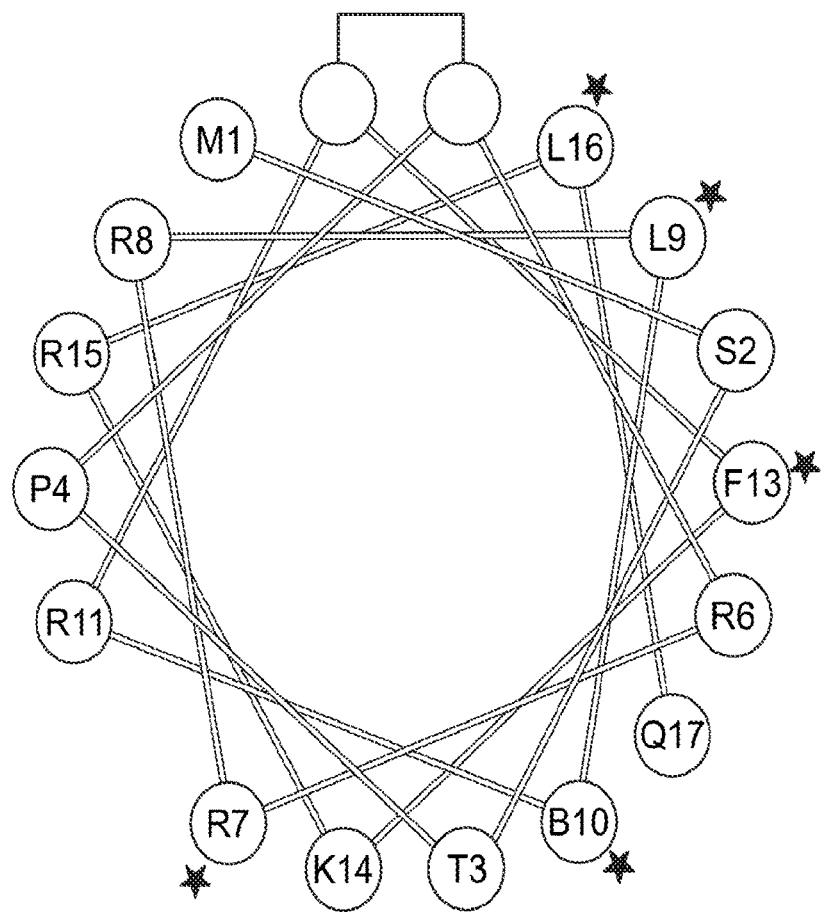
Figure 6D:
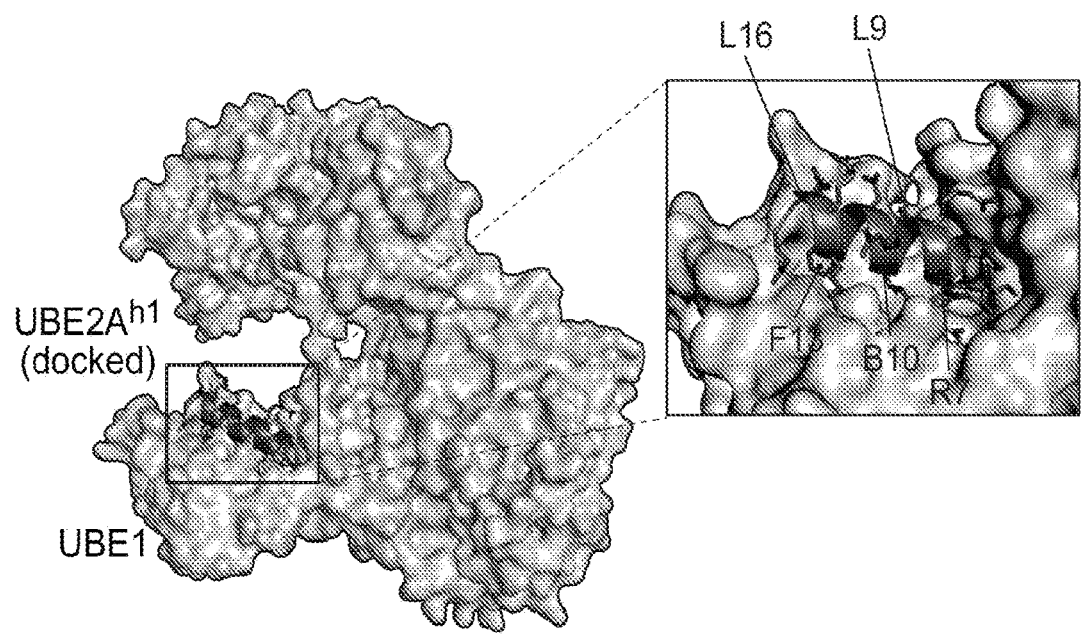
Figures 7A, 7B:
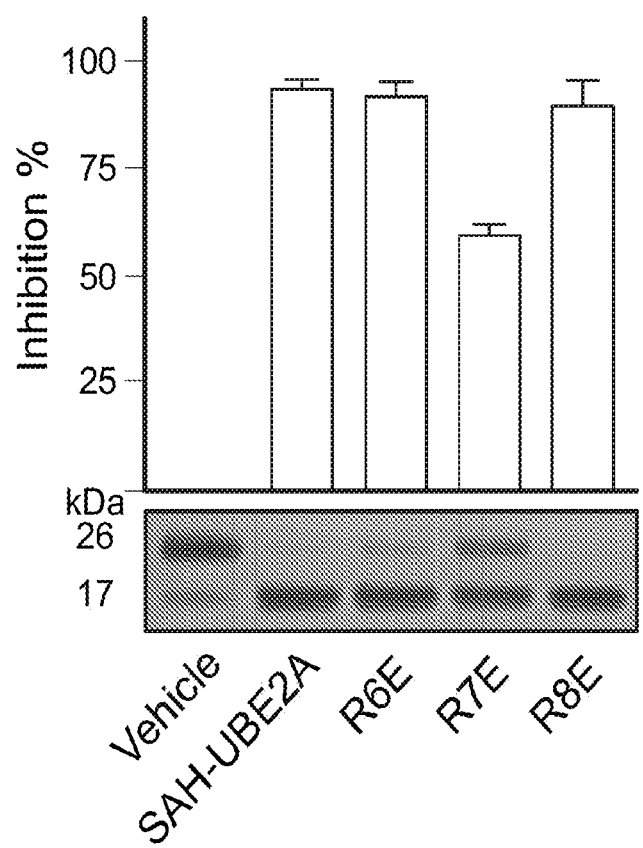
FIGS. 7A-7D identify which charged N-terminal residues are important for and contribute to target binding as determined by charge reversal mutagenesis.
Figure 7C:
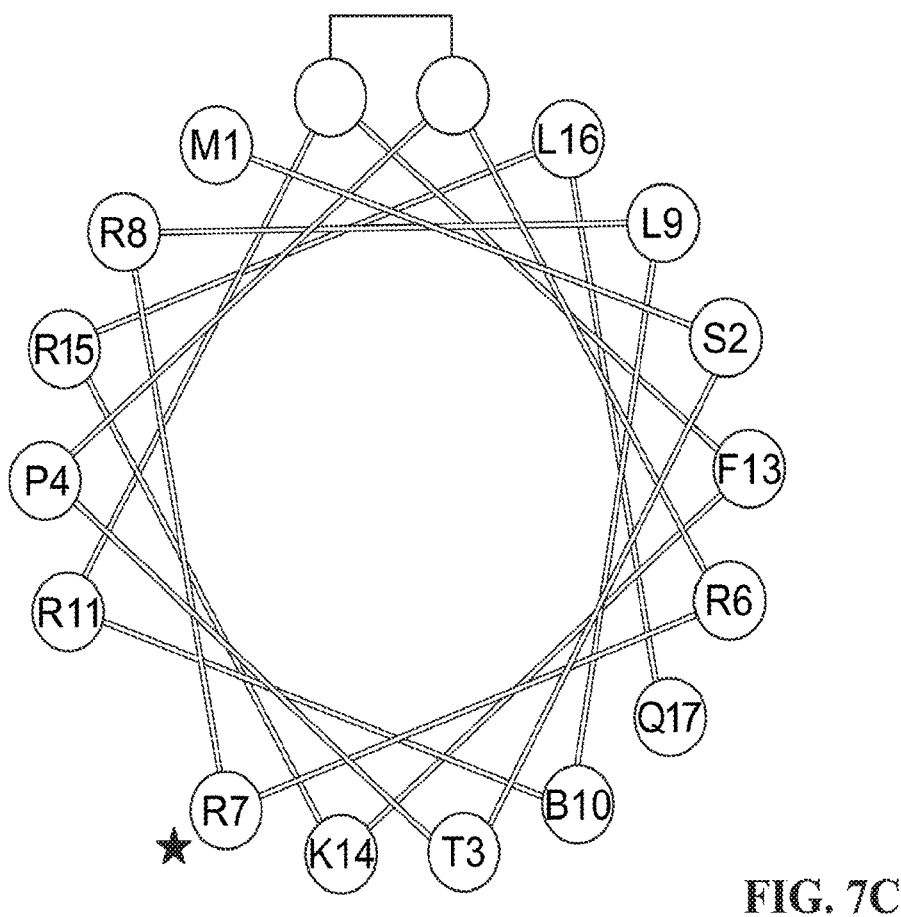
Figure 7D:
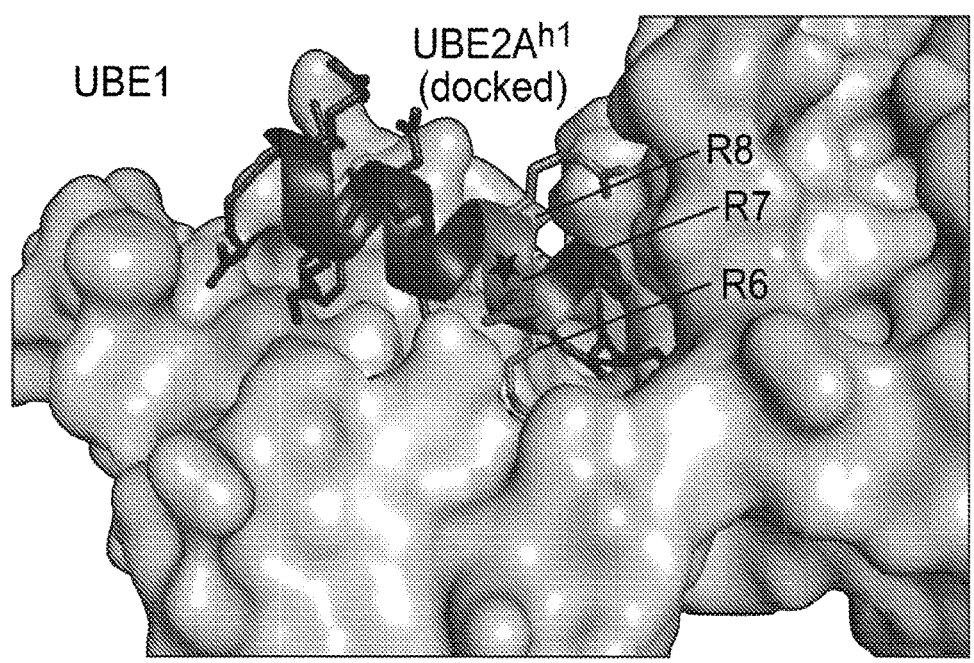

Alanine scanning mutagenesis (FIG. 6) and charge reversal (R to E amino acid substitutions) (FIG. 7) mutagenesis was performed on the SAH-UBE2A-11 (SEQ ID NO:132) peptide to identify the key amino acid residues that contribute to functional E2 hA stapled peptide activity (FIGS. 6 and 7). In vitro enzyme inhibition assays performed with the mutant SAH-UBE2A-11 peptides revealed amino acids R$_7$, L9, B$_{10}$, F13, and L16 (positions A$_4$, A$_6$, A$_7$, A$_{10}$, A$_{13}$) were particularly important for peptide function (FIGS. 6 and 7).

Example 5: Direct Binding of SAH-UBE2A to UBA1

Figure 8:
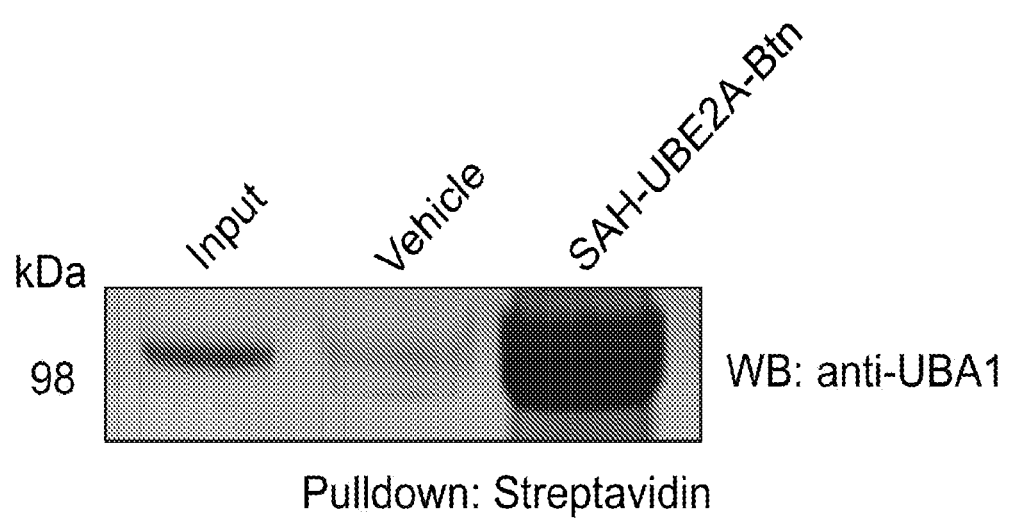
FIG. 8 is a silver-stained protein gel of a streptavidin-biotin pull-down experiment utilizing biotinylated SAH-UBE2A and recombinant UBA1, showing direct binding of biotinylated SAH-UBE2A to recombinant UBA1.
Figure 9A:
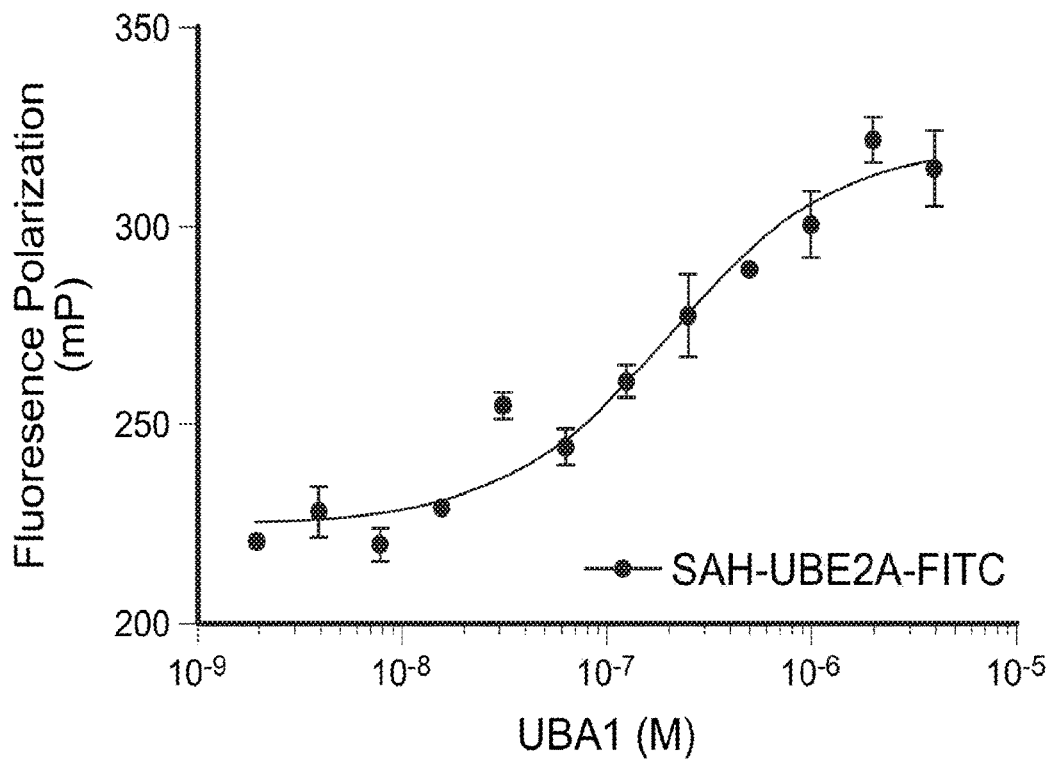
FIG. 9A and FIG. 9B are graphs depicting direct binding of SAH-UBE2A to recombinant UBA1, as measured by fluorescence polarization assay. The experiment depicted in FIG. 9A was performed in the absence of ubiquitin and ATP. The experiment depicted in FIG. 9B was performed in the presence of ubiquitin and ATP.
Figure 9B:
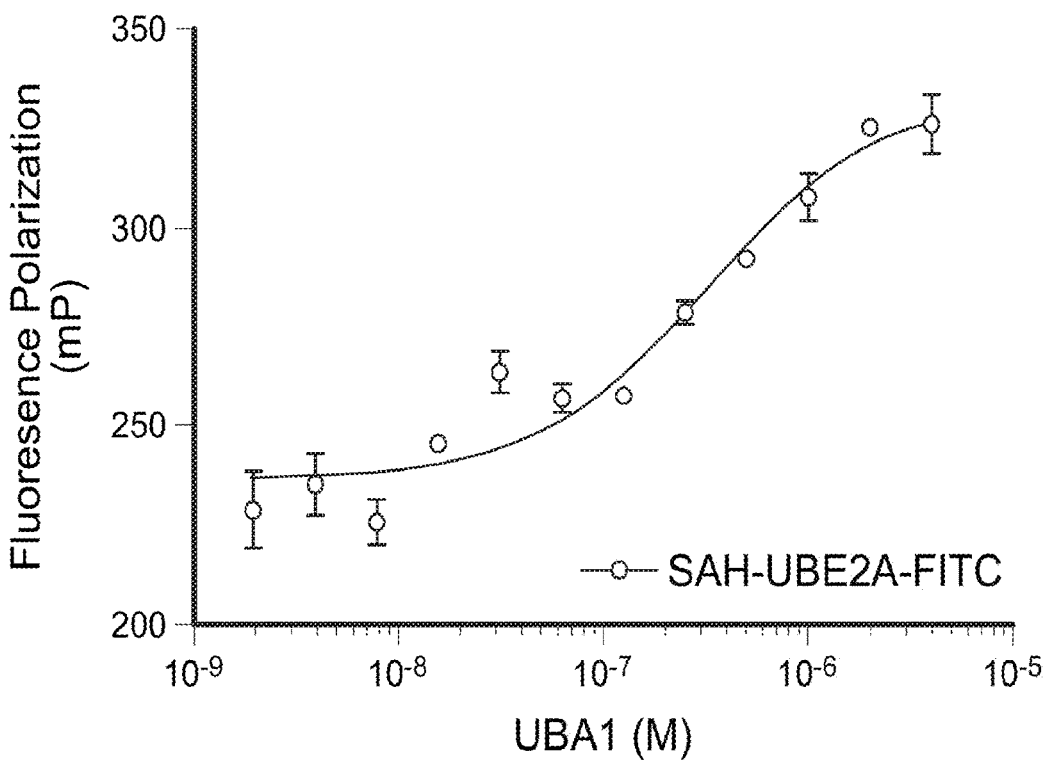
Figure 10:
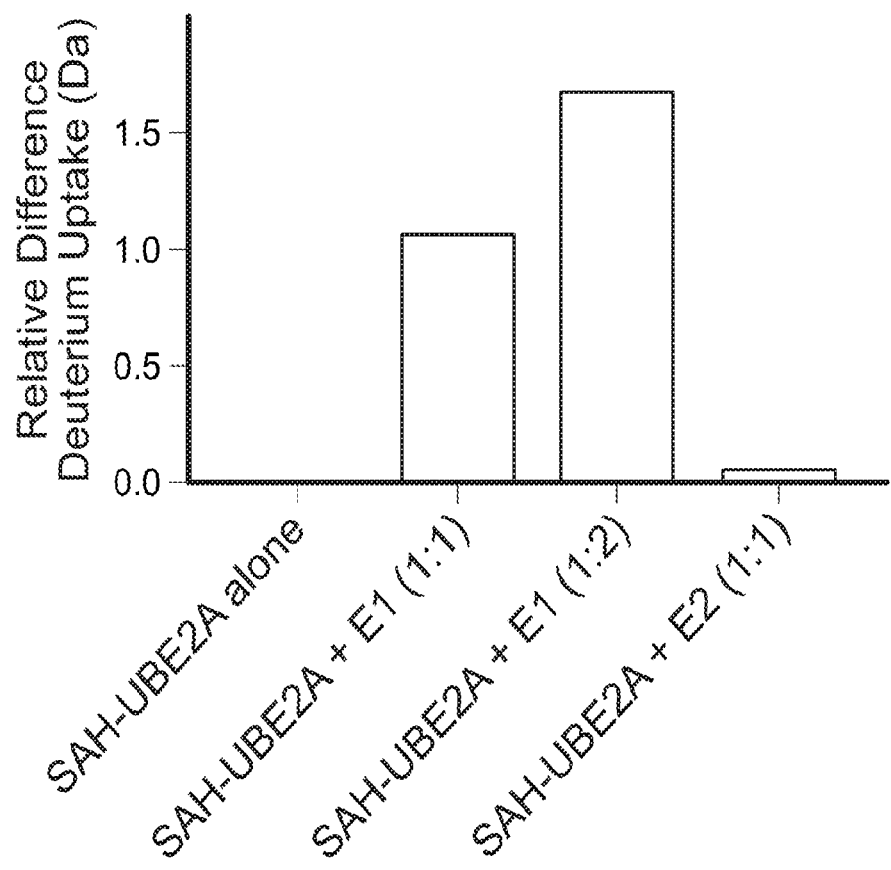
FIG. 10 is a graph showing hydrogen-deuterium exchange mass spectrometry analysis of SAH-UBE2A dose-responsively binding to E1 but not to E2.

Direct binding of SAH-UBE2A to UBA1 was assessed by streptavidin capture (FIG. 8), fluorescence polarization assay (FIG. 9), and hydrogen-deuterium exchange mass spectrometry (FIG. 10). Streptavidin capture of biotinylated peptide mixed with recombinant protein, followed by washing, elution, and detection by protein gel electrophoresis, demonstrated direct binding of SAH-UBE2A to UBA1 (FIG. 8). Fluorescence polarization assay performed in both the presence and absence of ubiquitin and ATP demonstrated that SAH-UBE2A binds to UBA1 independent of ubiquitin and ATP (FIG. 9). Hydrogen-deuterium mass exchange spectrometry showed that incubation with recombinant UBA1 dose-dependently protected SAH-UBE2A from deuterium uptake relative to incubation of the peptide alone. In contrast, incubation of the peptide with recombinant E2 resulted in no significant protection (FIG. 10).

Figure 11:
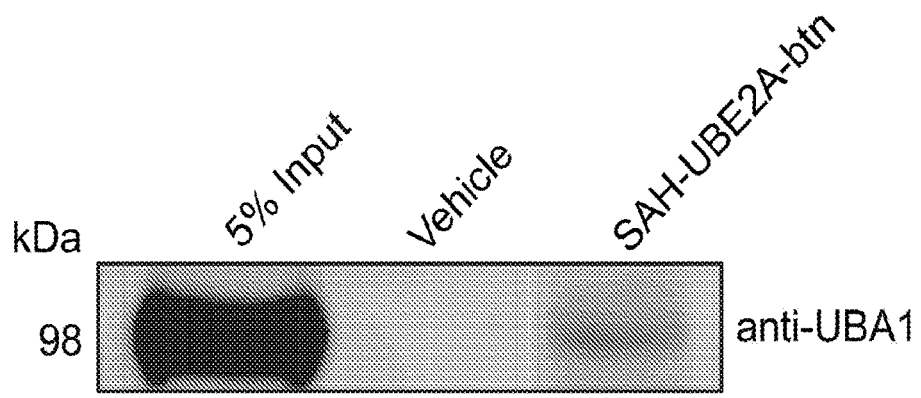
FIG. 11 is a western blot of a streptavidin-biotin pull-down experiment utilizing biotinylated SAH-UBE2A and HeLa cell lysate, depicting direct binding of SAH-UBE2A to native UBA1.
Figure 12:
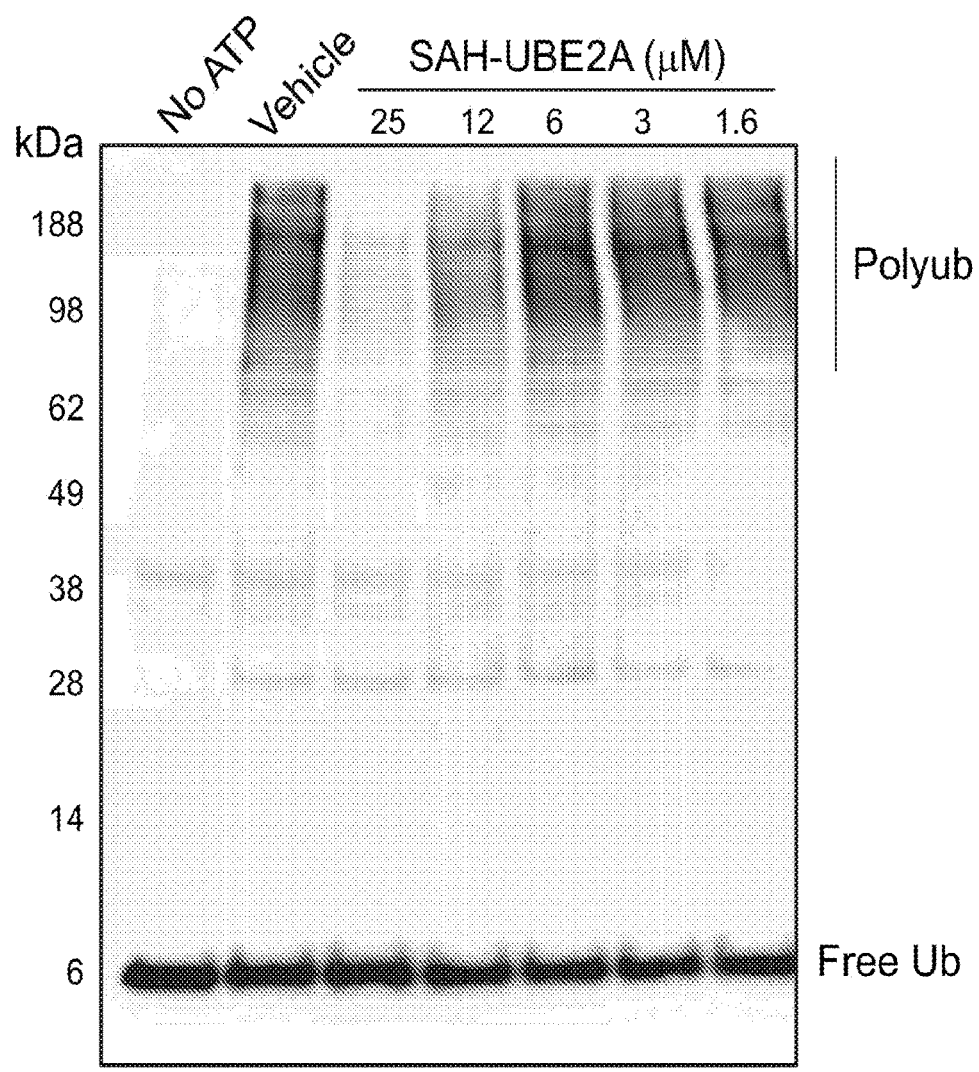
FIG. 12 is a western blot depicting inhibition of the ubiquitin pathway in cellular lysates by SAH-UBE2A. HeLa cell cytoplasmic fraction was incubated with SAH-UBE2A or vehicle control in the presence of excess ubiquitin and ATP regeneration solution and then subjected to non-reducing gel electrophoresis and western blotting against ubiquitin. SAH-UBE2A dose-dependently inhibited formation of polyubiquitin chains, as compared to vehicle control.

Example 6: SAH-UBE2A Binds to Native UBA1 and Inhibits the Ubiquitin Cascade in Cellular Lysates Direct binding of SAH-UBE2A to native UBA1 was demonstrated by streptavidin capture of biotinylated peptide mixed with HeLa cell lysate, followed by washing, elution, protein gel electrophoresis and western blotting for UBA1 (FIG. 11). Inhibition of the ubiquitin cascade in cancer cell lysates was demonstrated by ubiquitination assay. HeLa cell cytoplasmic fraction was incubated with SAH-UBE2A or vehicle control in the presence of excess ubiquitin and an ATP regeneration solution and then subjected to non-reducing gel electrophoresis and western blotting against ubiquitin. SAH-UBE2A dose-dependently inhibited formation of polyubiquitin chains, as compared to vehicle control (FIG. 12).

Example 7: Generation of Additional E2 hA Stapled Peptides

Additional stapled E2 hA peptides were designed and generated. Table 14 provides the sequences of the additional generated E2 hA stapled peptides, each of which inhibited E1-mediated thioester transfer to E2. In other words, each of the E2 hA stapled peptides of Table 14 was functional. Table 15 provides the sequences of the additional generated E2 hA stapled peptides, each of which showed impaired capacity to inhibit E1-mediated thioester transfer to E2. In other words, the E2 hA stapled peptides of Table 15 demonstrated notably impaired function, highlighting the importance of design, synthesis, testing, and iteration to arrive at optimally functional E2 hA stapled peptides for preclinical and clinical development.

TABLE 14

Generated, functional E2 hA stapled peptides. "B" is norleucine, "$X_1$" is R-octenyl alanine, and "$X_2$" is S-pentenyl alanine.

| SEQ ID NO: | Sequence |
|---|---|
| 807 | ASTP$X_1$RRRLB R$X_2$FKRLQ |
| 808 | BSTP$X_1$RRRLB R$X_2$FRRLQ |
| 809 | BSTP$X_1$ERRLB R$X_2$FKRLQ |
| 810 | BSTP$X_1$RRELB R$X_2$FKRLQ |
| 813 | BATP$X_1$RRRLB R$X_2$FKRLQ |
| 814 | BSAP$X_1$RRRLB R$X_2$FKRLQ |
| 815 | BSTA$X_1$RRRLB R$X_2$FKRLQ |
| 816 | BSTP$X_1$ARRLB R$X_2$FKRLQ |
| 818 | BSTP$X_1$RRALB R$X_2$FKRLQ |
| 821 | BSTP$X_1$RRRLB A$X_2$FKRLQ |
| 823 | BSTP$X_1$RRRLB R$X_2$FARLQ |
| 824 | BSTP$X_1$RRRLB R$X_2$FKALQ |
| 826 | BSTP$X_1$RRRLB R$X_2$FKRLA |

TABLE 15

Generated, non-functional E2 hA stapled peptides. "B" is norleucine, "$X_1$" is R-octenyl alanine, and "$X_2$" is S-pentenyl alanine.

| SEQ ID NO: | Sequence |
|---|---|
| 811 | BSTP$X_1$RRRLB E$X_2$FKRLQ |
| 812 | BSTP$X_1$RRRLB R$X_2$FKELQ |
| 817 | BSTP$X_1$RARLB R$X_2$FKRLQ |
| 819 | BSTP$X_1$RRRAB R$X_2$FKRLQ |
| 820 | BSTP$X_1$RRRLA R$X_2$FKRLQ |
| 822 | BSTP$X_1$RRRLB R$X_2$AKRLQ |
| 825 | BSTP$X_1$RRRLB R$X_2$FKRAQ |
| 853 | BSSPSPG$X_1$RRBLRD$X_2$VK |
| 854 | $X_1$ALKRIH$X_2$ELNDLARD |

Methods Used in Examples 1-7

Stapled peptide synthesis and purification: Stapled peptides were generated using solid phase Fmoc chemistry on a Symphony X peptide synthesizer, with amino acids sequentially added to rink amide AM resin. Two S-pentenyl alanine or one S-pentenyl alanine and one R-octenyl alanine non-natural amino acids replaced two native amino acids at the i, i+4 or i, i+7 positions, respectively. The all-hydrocarbon staple was formed by olefin metathesis using the Grubbs first-generation ruthenium catalyst, followed by peptide deprotection and cleavage from the resin. Peptides were N-terminally derivatized with acetyl, and C-termini were amidated or derivatized with FITC, as indicated. Peptides were purified by reverse phase high performance liquid chromatography and mass spectrometry (LC/MS) and quantified by amino acid analysis.

In vitro Binding Assays: To assess the binding and affinity of ligands to acceptor proteins, a fluorescence polarization assay (FPA) can be used, for example. The FPA technique measures the molecular orientation and mobility using polarized light and fluorescent tracer. When excited with polarized light, fluorescent tracers (e.g., FITC) attached to molecules with high apparent molecular weights (e.g., FITC-labeled peptides bound to a large protein) emit higher levels of polarized fluorescence due to their slower rates of rotation as compared to fluorescent tracers attached to smaller molecules (e.g., FITC-labeled peptides that are free in solution). FP assays were performed in binding buffer that either contained or did not contain ubiquitin (10 μM) and ATP (20 μM), as indicated.

Streptavidin-biotin pull-down assays: For recombinant protein pull-downs, 10 pmol recombinant human UBA1 was incubated with 5 nmol C-terminally biotinylated SAH-UBE2A or DMSO vehicle control in a total volume of 1 mL binding buffer (50 mM NaCl, 20 mM HEPES, pH 7.4, 5 mM DTT) for 1.5 hours at 4° C. 30 μL of pre-equilibrated streptavidin agarose beads were then added and incubated for an additional 1.5 hours at 4° C. The beads were pelleted by centrifugation and washed three times with NP-40 buffer (20 mM HEPES, pH 7.4, 50 mM NaCl, 5 mM DTT, 0.5% [v/v] NP-40) before eluting the protein sample from the beads by heating at 70° C. for 10 min in 3×SDS loading buffer. Samples were subjected to electrophoresis and silver staining (Pierce 24612). For pull-down from cellular lysates, 0.75 mg HeLa cell lysate was incubated with 5 nmol C-terminally biotinylated SAH-UBE2A or DMSO vehicle control in a total volume of 1 mL binding buffer (50 mM NaCl, 20 mM HEPES, pH 7.4, 5 mM DTT) containing protease-phosphatase inhibitor cocktail for 2 hours at 4° C. 30 μL of pre-equilibrated streptavidin agarose beads (ThermoFisher 20357) were then added and incubated for an additional 1.5 hours at 4° C. The beads were pelleted by centrifugation and washed three times with NP-40 buffer (20 mM HEPES, pH 7.4, 50 mM NaCl, 5 mM DTT, 0.5% [v/v] NP-40) before eluting the protein sample from the beads by heating at 70° C. for 10 min in 3×SDS loading buffer. Proteins were separated by SDS-PAGE gel electrophoresis and detected by western blot against UBE1 (Abcam ab34711). In vitro Enzyme Inhibition Assays: Recombinant human E1 activating enzyme UBA1 (10 nM), E2 enzyme (150 nM), ubiquitin (1 μM), and Mg-ATP (20 μM) are combined in the presence of peptide or vehicle control (1% DMSO) for 45 minutes at room temperature in buffer containing 50 mM NaCl, 50 mM HEPES pH 7.5. Control reaction includes no E1 enzyme. Reactions are quenched by addition of SDS-containing loading dye and samples are resolved on a 4-12% Bis-Tris protein gel under nonreducing conditions. Proteins are visualized by silver stain. Conjugation of ubiquitin to E2 by E1 is monitored by conversion of free E2 (17 kDa) to E2~ubiquitin conjugate (26 kDa). Quantitation of percent inhibition was calculated from densitometry of silver stain images. Error bars represent ±1 SEM calculated from three independent experiments.

HXMS analysis: Hydrogen-deuterium exchange mass spectrometry (HXMS) experiments were performed as described (Barclay, L. A. et al. Inhibition of Pro-apoptotic BAX by a noncanonical interaction mechanism. Molecular Cell 57, 873-886, doi: 10.1016/j.molcel.2015.01.014 (2015)). SAH-UBE2A was incubated alone or with the indicated molar ratio of recombinant human UBA1, UBE2D2, or vehicle control for ten minutes on ice, in buffer containing 50 mM NaCl, 5 mM MgCl2, 500 nM ubiquitin, 20 mM ATP, 5 mM DTT, 20 mM HEPES, pH 7.4. Deuterium labeling was initiated with an 18-fold dilution into D2O buffer (20 mM HEPES, 50 mM NaCl, pD 8). After 10 s of labeling, the labeling reaction was quenched with the addition of an equal volume of quenching buffer (0.8 M guanidinium chloride, 0.8% [v/v] formic acid). Samples were then injected and peptides were trapped intact and desalted on a VanGuard Pre-Column trap (2.1 mm×5 mm, ACQUITY UPLC BEH C18, 1.7 μm) for 3 min, eluted from the trap using a 5%-35% gradient of acetonitrile over 6 minutes at a flow rate of 65 μL/min, and then separated using an ACQUITY UPLC HSS T3, 1.8 μm, 1.0 mm×50 mm column on a Waters nanoACQUITY LC. The Waters Synapt G2Si mass spectrometer was operated in ion mobility mode and data analyzed. All mass spectra were processed using DynamX 3.0 (Waters Corporation). Deuterium levels were not corrected for back exchange and thus reported as relative. All changes noted were consistent in at least n=2 bioreplicates.

Cellular Lysate Enzyme Inhibition Assays: Cellular lysate assays were performed with 1 mg/mL final concentration HeLa S100 lysate fraction and the indicated concentration of peptide or DMSO vehicle control in an assay buffer containing 1×ATP regeneration solution, 20 mM HEPES, 50 mM NaCl, 5 mM MgCl2, 2 mM DTT, 100 nM ubiquitin aldehyde, and a protease-phosphatase inhibitor cocktail at pH 7.4. Reactions were initiated by addition of ubiquitin to a final concentration of 100 μM and allowed to proceed for 30 minutes at room temperature, followed by quenching with non-reducing LDS loading buffer. Proteins were separated by SDS-PAGE gel electrophoresis and detected by western blot against polyubiquitin (Cell Signaling Technology CST3936).

Example 8: Modification of SAH-E2 Peptides to Incorporate Electrophilic Warheads To create additional E2 hA stapled peptide variants with the potential to form a covalent bond with Cys1039 of UBA1, a number of variants in which a "warhead" replaced positions $A_8$ or $A_{11}$ were generated. The variants were based on the E2 hA sequences of Ubc15 (SEQ ID NO:2), UBE2D2 (SEQ ID NO:10), and UBE2A (SEQ ID NO:4). Tables 16 and 17 provide the sequences of the various E2 hA stapled peptide warhead variants generated. Warhead positions were determined based on docking of the peptide onto the crystal structure of human E1 (PDF 6dc6). Positions on or adjacent to the E1 binding face of the peptide and proximal to Cys1039 of UBA1 (SEQ ID NO:845) were selected for substitution with a warhead. The alpha carbon of amino acid consensus position $A_7$ is estimated to be 5.4 angstroms from the sulfur of Cys1039 of UBA1 (SEQ ID NO:845). The alpha carbon of amino acid consensus position $A_8$ is estimated to be 6.6 angstroms from the sulfur of Cys1039 of UBA1 (SEQ ID NO:845). The alpha carbon of amino acid consensus position $A_{11}$ is estimated to be 4.8 angstroms from the sulfur of Cys1039 of UBA1 (SEQ ID NO:845).

TABLE 16

Generated E2 hA warhead-bearing stapled peptides. "J" is acrylamide-bearing version of diamino butanoic acid ("Dab"), "B" is norleucine, "$X_1$" is R-octenyl alanine, and "$X_2$" is S-pentenyl alanine

| SEQ ID NO: | Sequence* | Warhead Position | Staple Position |
| --- | --- | --- | --- |
| 841 | BPSS$X_1$SRQLLR$X_2$QLJEIQ | $A_{11}$ | $A_1$ and $A_8$ |
| 842 | BPSSA$X_1$RQLLRJ$X_2$LKEIQ | $A_8$ | $A_2$ and $A_9$ |
| 844 | BPSSA$X_1$RQLLRK$X_2$LJEIQ | $A_{11}$ | $A_2$ and $A_9$ |
| 727 | B$X_1$LKRIHK$X_2$LJDLARD | $A_{11}$ | $A_2$ and $A_9$ |
| 680 | BSTP$X_1$RRRLJR$X_2$FKRLQ | $A_7$ | $A_2$ and $A_9$ |
| 752 | BSTP$X_1$RRRLBR$X_2$FJRLQ | $A_{11}$ | $A_2$ and $A_9$ |

TABLE 17

Generated E2 hA warhead-bearing stapled peptides. "J" is acrylamide-bearing version of diamino butanoic acid ("Dab"), "B" is norleucine, "$X_1$" is R-octenyl alanine, and "$X_2$" is S-pentenyl alanine.

| SEQ ID NO: | Sequence | Warhead Position | Staple Position |
| --- | --- | --- | --- |
| 763 | $X_1$ALKRIH$X_2$ELJDLARD | $A_{11}$ | $A_1$ and $A_8$ |
| 691 | B$X_1$LKRIHJ$X_2$LNDLARD | $A_8$ | $A_2$ and $A_9$ |

Warhead-bearing E2 hA stapled peptides of SEQ ID NOs: 727, 841, 842, and 844 inhibited E1-mediated thioester transfer to E2. Warhead-bearing E2 hA stapled peptides of SEQ ID NOs: 680 and 752 inhibited E1-mediated thioester transfer to E2. Warhead-bearing E2 hA stapled peptides of SEQ ID NOs: 691 and 763 did not inhibit E1-mediated thioester transfer to E2.

Example 9. Generated Stapled Peptides and Generated Warhead-Bearing Stapled Peptides Stapled peptides and warhead-bearing stapled peptides listed in Tables 18 and 19 were generated and tested. Note that this disclosure also encompasses variants of those stapled peptides that terminate with a C-terminal "Z", where the variant lacks the Z. In addition, this disclosure features stapled peptides that differ from the sequences listed below at 1 to 10 (e.g., 1, 2, 3, 4, 5, 6, 7, 8, 9, 10) amino acid positions, except that that the non-natural amino acids ($X_1$, $X_2$) are not substituted. In some cases, the substituted residues are those that are not predicted to be involved in interacting with E1. These variants inhibit the E1-E2 interaction. In some cases, these variants inhibit E1-mediated thioester transfer to E2. The disclosure features a pharmaceutical composition comprising any of the peptides listed in Tables 18 and 19 without the terminal Z or salts thereof (e.g., acetate, sulfate, chloride), and a pharmaceutically acceptable carrier; as well as methods of their use in treating a cancer or other E1-expressing or -dependent disease.

TABLE 18

Generated Stapled Peptides

| SEQ ID NO: | Gene | Sequence |
|---|---|---|
| 1344 | Ubc15-tr-m_4 | BPSSAX$_1$RQLLRKX$_2$LKEIQK |
| 1345 | UBE2D2-m_5 | BX$_1$LKIHKX$_2$LNDLARDZ |
| 1346 | UBE2G2-tr-m_6 | BAGTX$_1$LKRLBAX$_2$YKZ |
| 1347 | UBE2A/UBE2B-tr-m_7 | BSTPX$_1$ARRLBRX$_2$FKRLQZ |
| 1348 | UBE2A/UBE2B-tr-m | BSTPX$_1$RARLBRX$_2$FKRLQZ |
| 1349 | UBE2A/UBE2B-tr-m | BSTPX$_1$RRALBRX$_2$FKRLQZ |
| 1350 | UBE2A/UBE2B-tr-m | BSTPX$_1$ERRLBRX$_2$FKRLQZ |
| 1351 | UBE2A/UBE2B-tr-m | BSTPX$_1$RERLBRX$_2$FKRLQZ |
| 1352 | UBE2A/UBE2B-tr-m | BSTPX$_1$RRELBRX$_2$FKRLQZ |
| 1353 | UBE2A/UBE2B-tr-m | BSTPX$_1$RARAARX$_2$FKRLQZ |
| 1354 | UBE2A/UBE2B-tr-m | BSTPX$_1$RARAARX$_2$FKRLQ |
| 1355 | UBE2A/UBE2B-tr-m | BSTPX$_1$RRELBEX$_2$FKRLQZ |
| 1356 | UBE2A/UBE2B-tr-m | BSTAX$_1$ERELBEX$_2$FAALQZ |
| 1357 | UBE2A/UBE2B-tr-m | BSTPX$_1$RRRLCRX$_2$FKRLQ |
| 1358 | UBE2A/UBE2B-tr-m | BSTPX$_1$RRRLCRX$_2$FKRLQZ |

In Table 18, "B" is norleucine; "$X_1$" is R-octenyl alanine; "X2" is S-pentenyl alanine; "tr"=truncated; "m"=mutant; Z=lys(Biotin) (note that the disclosure also encompasses each of the above peptides but without the terminal "Z", where present)

TABLE 19

Generated Warhead-Bearing Stapled Peptides

| SEQ ID NO: | Gene | Sequence |
|---|---|---|
| 1359 | UBE2A/UBE2B-tr-m | BSTPX$_1$RRRLJRX$_2$FKRLQ |
| 1360 | UBE2A/UBE2B-tr-m | BSTPX$_1$RRRLBRX$_2$FJRLQ |
| 1361 | UBE2A/UBE2B-tr-m | BSTPX$_1$RRRLBRX$_2$FKRUQZ |
| 1362 | UBE2A/UBE2B-tr-m | BSTPX$_1$RRRLBRX$_2$UAALQZ |
| 1363 | UBE2A/UBE2B-tr-m | USTPX$_1$RRRLBRX$_2$FKRLQZ |
| 1364 | UBE2A/UBE2B-tr-m | BSTPX$_1$RRRLURX$_2$FKRLQZ |
| 1365 | UBE2A/UBE2B-tr-m | BSTPX$_1$RRRLBRX$_2$UKRLQZ |

In Table 19, "B" is norleucine, "$X_1$" is R-octenyl alanine, and "X2" is S-pentenyl alanine; "J" is diamino butanoic acid terminating in bromoacetyl; "U" is a non-natural benzophenone-containing amino acid; "tr"=truncated; "m"=mutant; Z=lys(Biotin).

Figure 16:
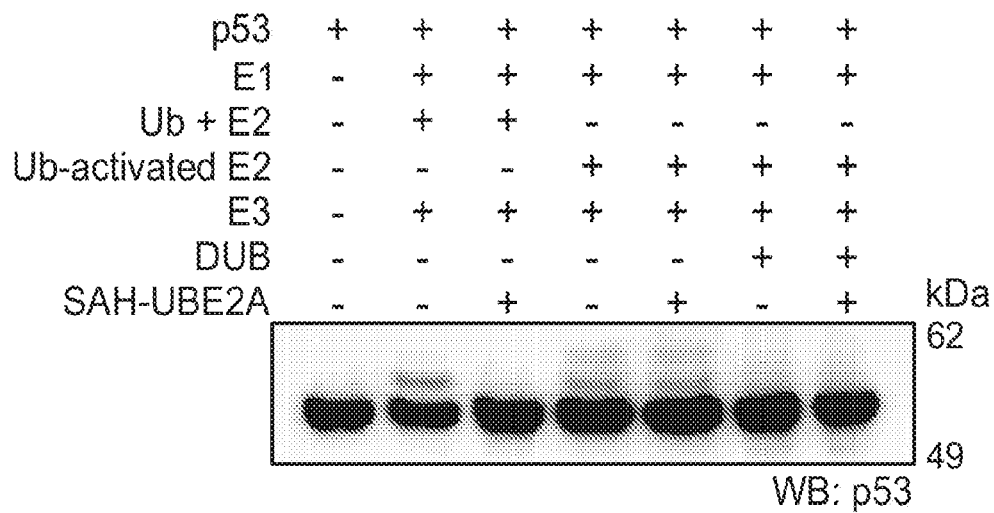
FIG. 16 shows is a Western blot of an in vitro recombinant ubiquitin pathway reconstitution assay. E1: UBA1; E2: UBE2A E3: HDM2 Ub: ubiquitin; DUB: deubiquitinase USP7; and SAH-UBE2A: SEQ ID NO:132. SAH-UBE2A inhibits the ubiquitination of p53 when co-incubated with E1 (UBA1), E2 (UBE2A), E3 (HDM2), Ub and ATP. p53 ubiquitination is detected as protein laddering when the western blot is developed with anti-p53 antibody. Substitution of pre-activated E2 in the place of unactivated E2 and Ub circumvents the inhibitory activity of SAH-UBE2A, demonstrating the specificity of SAH-UBE2A inhibition for the activation of E2. Addition of deubiquitinase (DUB) USP7 to the reaction mixture results in the deubiquitination of p53, detected as loss of protein laddering, regardless of SAH-UBE2A presence, further demonstrating the specificity of SAH-UBE2A inhibiting the activation of E2 and no other steps in the ubiquitin cascade.
Figure 17:
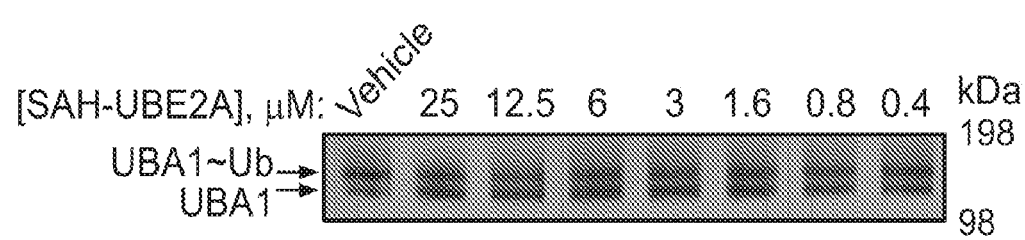
FIG. 17 shows silver staining of in vitro thioester transfer inhibition assay samples run on Bis-Tris protein gels under nonreducing conditions with a running time optimized to resolve UBA1 from ubiquitin-conjugated UBA1 (UBA1~Ub). SAH-UBE2A (SEQ ID NO: 132) has no effect on the ability of UBA1 to form a covalent UBA1~Ub thioester adduct, the enzymatic step in the UBA1 catalytic cycle preceding thioester transfer to E2, as demonstrated by the presence of a UBA1, UBA1~Ub doublet in the thioester transfer enzymatic assay at endpoint across all concentrations of SAH-UBE2A.
Figure 18:
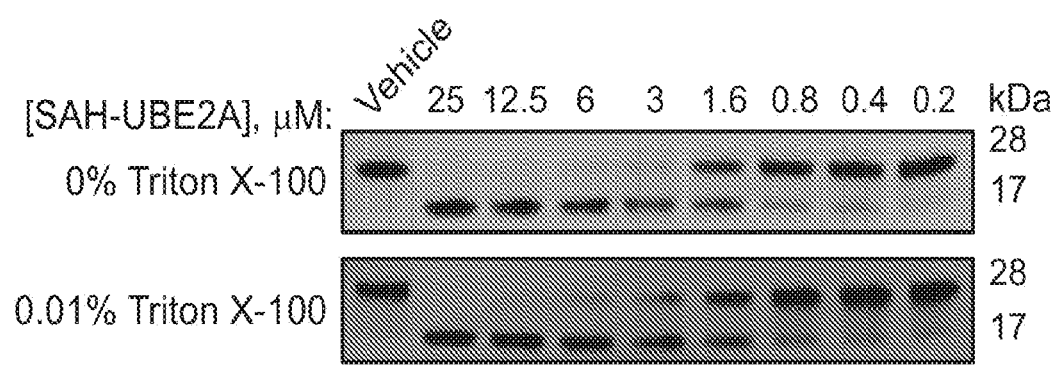
FIG. 18 shows silver staining of in vitro thioester transfer inhibition assay samples run on Bis-Tris protein gels under nonreducing conditions in the absence or presence of nonionic detergent (0.01% Triton X-100). The addition of Triton X-100 to the assay buffer has no effect on the inhibitory activity of SAH-UBE2A (SEQ ID NO: 132).
Figure 19:
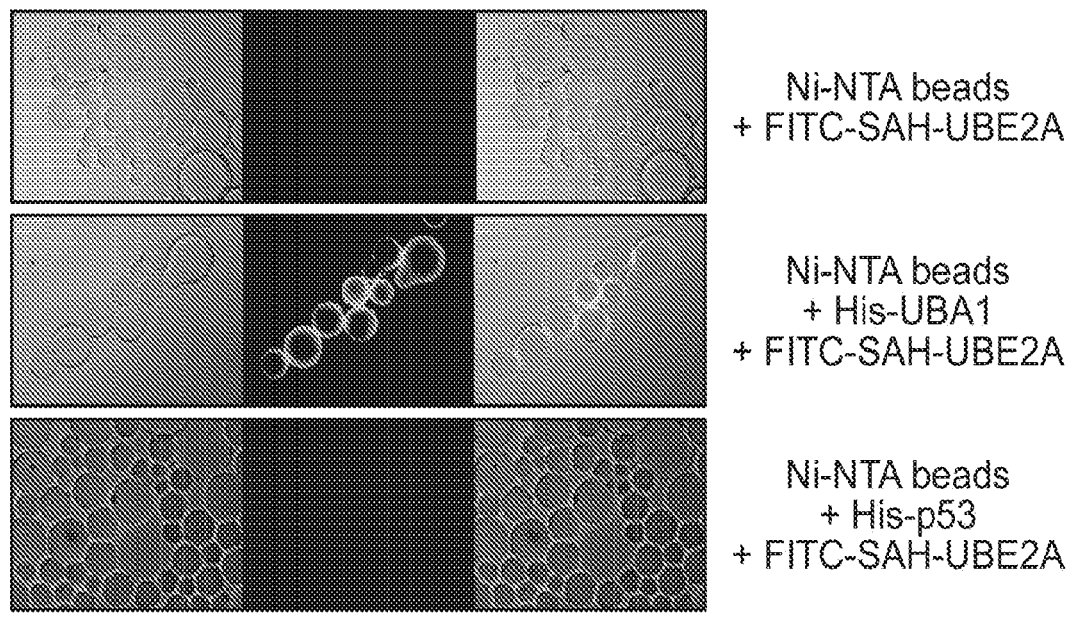
FIG. 19 are brightfield and fluorescence microscopy images depicting specific direct binding of FITC-SAH-UBE2A (FITC conjugated to SEQ ID NO: 132) to recombinant UBA1 in the presence of Ni-NTA agarose beads (top row), Ni-NTA agarose beads and His-UBE1 (middle row), and Ni-NTA agarose beads and His-p53 (bottom row). Ni-NTA agarose beads were used to capture His-tagged UBE1 or His-tagged p53 as an unrelated protein control, followed by incubation with FITC-SAH-UBE2A. FITC-SAH-UBE2A only bound to the beads in the presence of His-UBE1 (middle row) and did not bind nonspecifically to the beads (top row) or to His-p53 (bottom row).

Example 10. E2 hA Stapled Peptides Display Highly Specific Inhibitory Activity Against E1 Thioester Transfer Activity SAH-UBE2A-11 (SEQ ID NO:132) inhibitory activity is highly specific to E1-mediated thioester transfer to E2, as exemplified by its lack of effect on or interference with non-E1 proteins or activities. Examining the specificity of the mechanism of action of SAH-UBE2A-11 (SEQ ID NO:132), SAH-UBE2A-11 (SEQ ID NO:132) showed no effect on the ability of UBA1 to covalently charge itself with ubiquitin, the enzymatic step preceding thioester transfer to E2 (FIG. 17). Furthermore, the entire ubiquitin cascade was reconstituted in vitro to demonstrate that SAH-UBE2A-11 (SEQ ID NO:132) only affected the cascade at the level of inhibiting E2 charging (FIG. 16). When incubated with protein substrate p53 and ubiquitin cascade components E1 (UBA1), E2 (UBE2A), E3 (HDM2), Ub, and ATP, SAH-UBE2A-11 (SEQ ID NO:132) inhibited the ubiquitination of p53 protein. However, when E2 that has been pre-activated with Ub is included in the reaction mixture instead of uncharged E2 and Ub, SAH-UBE2A-11 (SEQ ID NO:132) had no effect on the ubiquitination of p53; the circumvention of SAH-UBE2A-11's inhibitory effect with precharged E2 demonstrates the specificity of the inhibitory effect of SAH-UBE2A-11 (SEQ ID NO:132) against the charging of E2. SAH-UBE2A-11 (SEQ ID NO:132) also had no effect on the activity of the deubiquitinase enzyme USP7 against p53 (FIG. 16). To exclude any influence of potential peptide aggregation on the activity of SAH-UBE2A-11 (SEQ ID NO:132), it was further shown that the inhibitory activity of the peptide against UBA1 was not affected at all by the presence of non-ionic detergent, which can otherwise solubilize small molecule or peptide aggregates (FIG. 18). In a further examination of direct and specific binding of SAH-UBE2A-11 (SEQ ID NO:132) to UBA1, fluorescence microscopy showed FITC-labeled SAH-UBE2A-11 (SEQ ID NO:132) binds specifically to Ni-NTA beads tagged with His-UBA1 and did not engage untagged beads or beads tagged with an unrelated protein (His-p53), indicative of specific peptide binding to UBA1 (FIG. 19).

Figure 20:
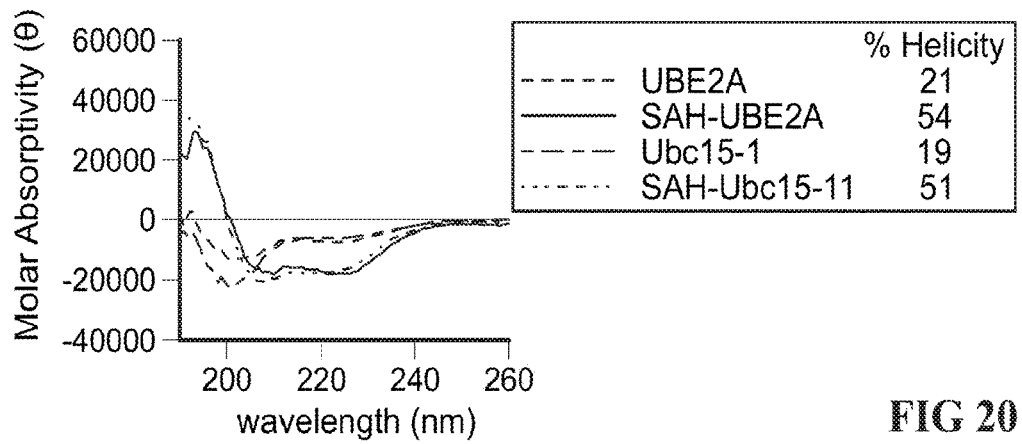
FIG. 20 is a graph showing the α-helicity of peptides UBE2A (BSTPARRRLBRDFKRLQ; SEQ ID NO: 1343), SAH-UBE2A (SEQ ID NO: 132), Ubc15-1 (BPSSAS-RQLLRKQLKEIQK; SEQ ID NO: 1340), and SAH-Ubc15-11 (SEQ ID NO: 50) as measured by circular dichroism. Peptide stapling induces α-helical folding of the Ubc15 and UBE2A peptides, which are otherwise random coils in solution.
Figure 21:
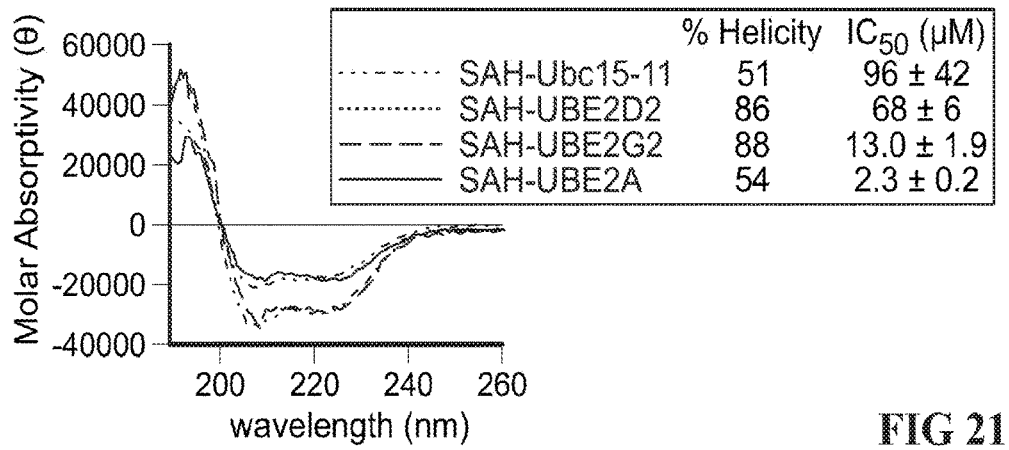
FIG. 21 is a graph showing the α-helicity of peptides SAH-Ubc15-11 (SEQ ID NO: 50), SAH-UBE2D2 (SEQ ID NO:107), SAH-UBE2G2 (SEQ ID NO: 133), and SAH-UBE2A (SEQ ID NO: 132), as measured by circular dichroism. Peptide stapling induces α-helical folding, but the amino acid sequence itself dictates the presence or absence of E1-inhibitory activity.
Figure 22:
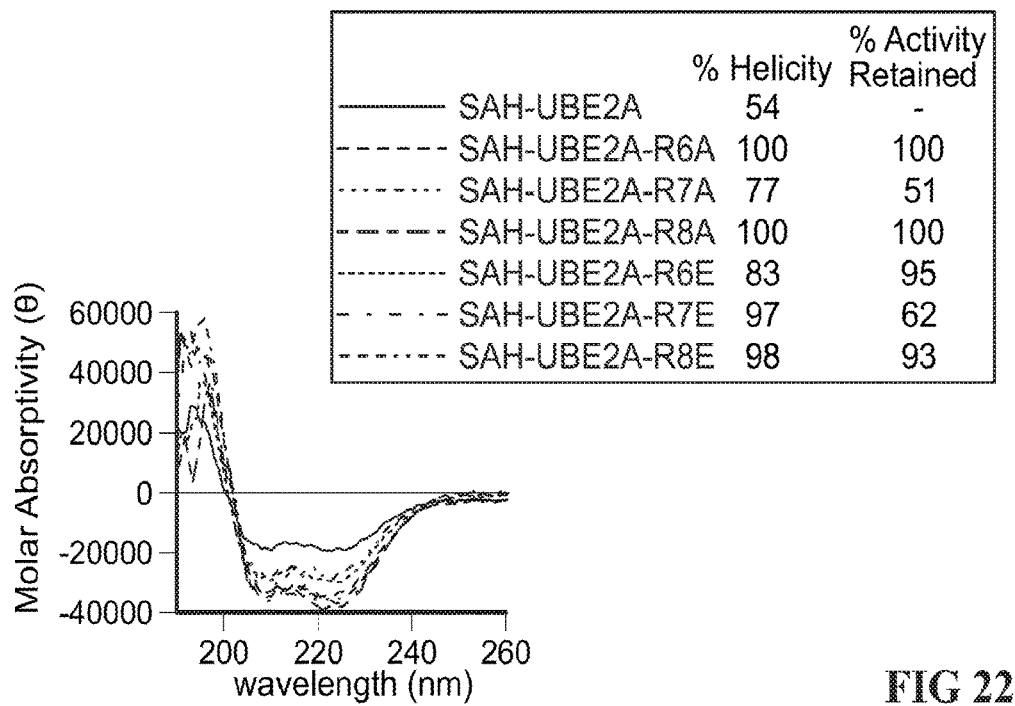
FIG. 22 is a graph showing the α-helicity of peptides SAH-UBE2A (SEQ ID NO: 132), SAH-UBE2A-R6A (SEQ ID NO: 1326), SAH-UBE2A-R7A (SEQ ID NO: 1327), SAH-UBE2A-R8A (SEQ ID NO: 1328), SAH-UBE2A-R6E (SEQ ID NO: 1337), SAH-UBE2A-R7E (SEQ ID NO: 1338), and SAH-UBE2A-R8E (SEQ ID NO: 1339), as measured by circular dichroism. Peptide stapling induces α-helical folding, but the amino acid sequence itself dictates the presence or absence of E1-inhibitory activity.

Example 11. E2 hA Stapled Peptides Undergo α-Helical Structural Reinforcement Upon Stapling, with Biological Activity of α-Helical E2 hA Peptides Dependent on Peptide Sequence Peptide stapling induced α-helical folding in E2 hA peptides. Circular dichroism showed that the unmodified UBE2A peptide (BSTPARRRLBRDFKRLQ, wherein "B" is norleucine; SEQ ID NO: 1343) displayed 21% helicity in solution, corresponding to predominant adoption of a random coil conformation, while SAH-UBE2A-11 (SEQ ID NO:132) showed stabilization of alpha-helical conformation with 54% helical content (FIG. 20). Similarly, peptide stapling induced alpha-helical folding in the Ubc15 peptide backbone, with the unmodified Ubc15-1 peptide (Ubc15-tr-m-z_1z; BPS SASRQLLRKQLKEIQZ, wherein "B" is norleucine and "Z" is a biotinylated lysine (Lys(biotin)); SEQ ID NO:1340)) displaying only 19% helical content and the stapled SAH-Ubc15-11 peptide (SEQ ID NO:50) displaying 51% helical content. Helical shape alone was not sufficient to impart biologic activity to E2 hA peptides, as the percent helicity of a series of E2 hA peptides (SEQ ID NOs: 50, 107, 132, 133; 1327-1329; and 1337-1339) did not correlate with their inhibitory activities, which required compatible amino acid sequence in addition to alpha-helical reinforcement (FIGS. 20-22).

Example 12. E2 hA Stapled Peptides are Protease Resistant

Figure 23:
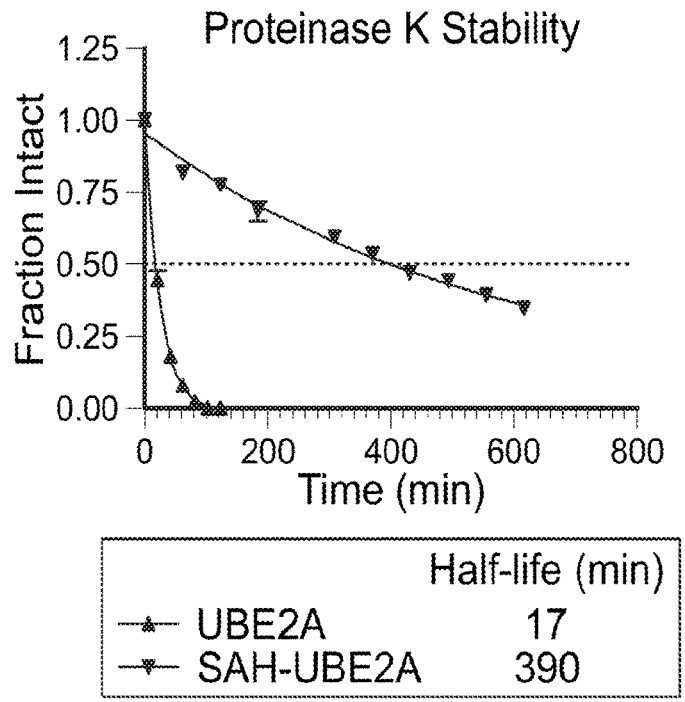
FIG. 23 is a graph showing the relative protease stability of UBE2A (SEQ ID NO: 4) and SAH-UBE2A (SEQ ID NO: 132) under proteinase K digestion conditions. UBE2A and SAH-UBE2A were incubated with proteinase K and amount of intact peptide was quantified over time by a liquid chromatography/mass spectrometry based-assay. Peptide stapling increased the protease stability of SAH-UBE2A by 23-fold over unstapled UBE2A.

Peptide stapling conferred proteolytic stability to E2 hA peptides. The half-life of SAH-UBE2A-11 (SEQ ID NO:132) upon solution proteinase K digestion was >6 hours, prolonged by 23-fold over the unstapled peptide UBE2A (BSTPARRRLBRDFKRLQ; SEQ ID NO:1343) (FIG. 23).

Figure 24:
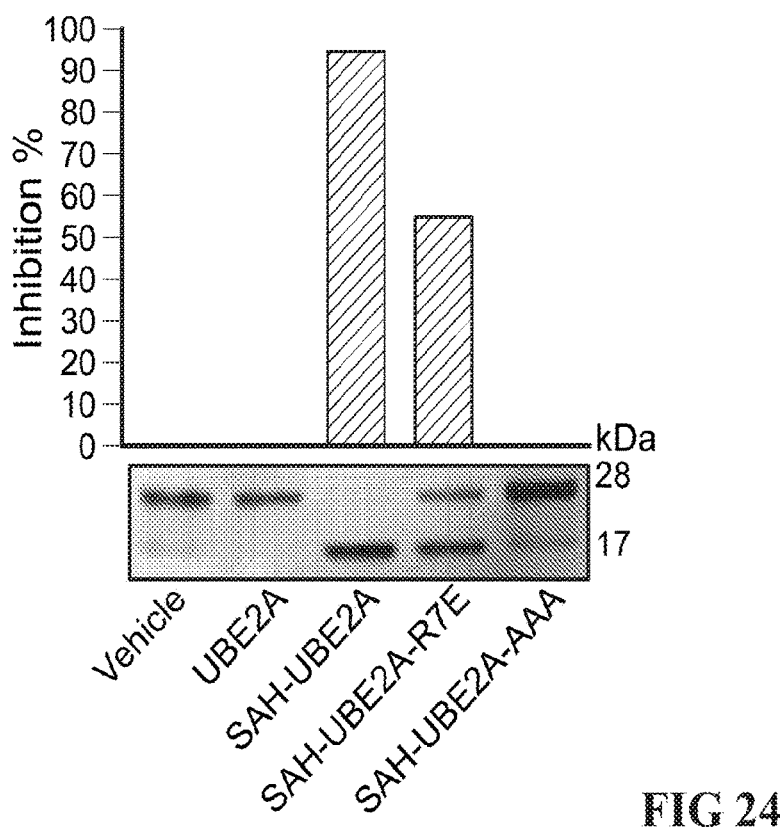
FIG. 24 shows comparative inhibition of E1-mediated ubiquitin transfer to E2 by UBE2A (BSTPARRRL-BRDFKRLQ SEQ ID NO: 1343), SAH-UBE2A (SEQ ID NO: 132), SAH-UBE2A-R7E (SEQ ID NO: 1338), and SAH-UBE2A-AAA (BSTPX$_1$RARAARX$_2$FKRLQ; SEQ ID NO: 1354). Top panel is a quantification of the band-shift experiment shown in the bottom panel. Unstapled UBE2A (SEQ ID NO:4) and triple point mutant SAH-UBE2A-AAA (BSTPX$_1$RARAARX$_2$FKRLQ; SEQ ID NO: 1353) display no inhibitory activity against UBE1 enzymatic function, as assessed by thioester transfer assay. Single point mutant SAH-UBE2A-R7E (SEQ ID NO: 1338) has reduced inhibitory activity as compared to SAH-UBE2A.
Figure 25:
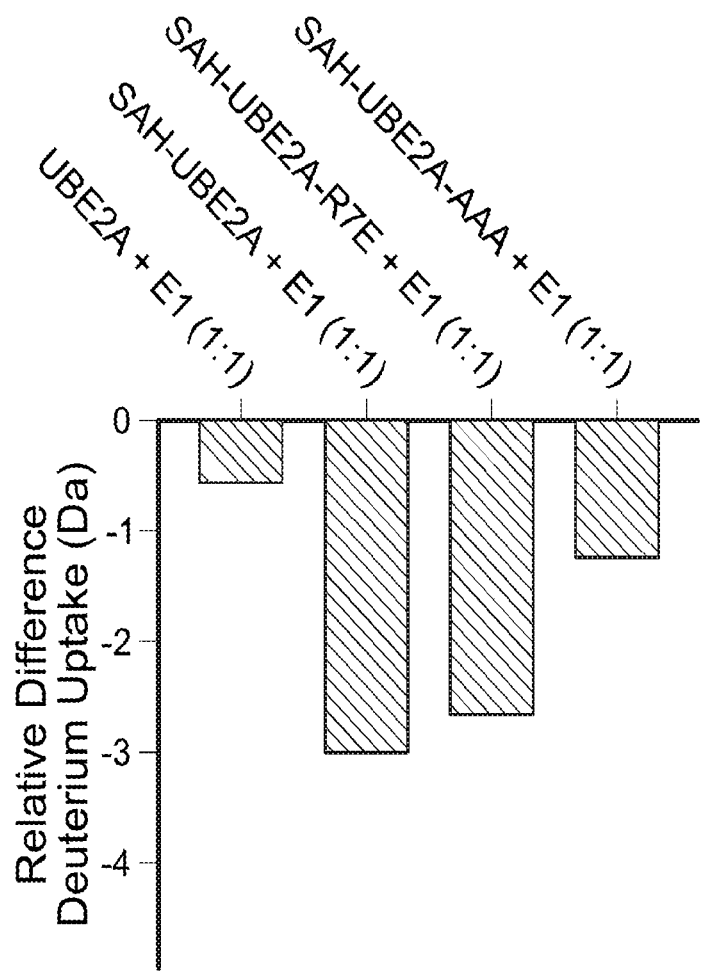
FIG. 25 is a graph quantifying direct interaction between UBA1 and a panel of UBE2A (BSTPARRRLBRDFKRLQ SEQ ID NO: 1343), SAH-UBE2A (SEQ ID NO: 132), SAH-UBE2A-R7E (SEQ ID NO: 1338), and SAH-UBE2A-AAA (BSTPX$_1$RARAARX$_2$FKRLQ; SEQ ID NO: 1354), as measured by hydrogen-deuterium exchange mass spectrometry analysis.

Example 13. hA Stapled Peptides Display Explicit Binding and Biological Structure-Activity-Relationship with Specific Mutations that Disrupt the Binding Interface Progressively Impairing the Inhibitory Activity of SAH-UBE2A As demonstrated in Example 4 above, point mutations $R_7A$, L9A, and B10A were each found to impair the inhibitory activity of SAH-UBE2A-11 (See FIG. 6B). A combination of the three point mutations, such as in the peptide SAH-UBE2A-AAA (BSTPX$_1$RARAARX$_2$FKRLQ; SEQ ID NO:1354), was found to progressively impaired inhibitory activity as compared to the single point mutation peptide SAH-UBE2A-$R_7$E. The triple mutant peptide displayed negligible inhibitory activity, similar to the unstapled UBE2A peptide that lacks helical structure (BSTPARRRL-BRDFKRLQ; SEQ ID NO:1343) (FIG. 24). The degree of impairment of the inhibitory activities of single and triple point mutant peptides correlated with the degree of binding of each peptide to UBA1, as measured by hydrogen-deuterium exchange mass spectrometry (FIG. 25).

Additional Methods Used in Examples 10-13

In Vitro Ubiquitin Pathway Reconstitution Assay: Reactions containing recombinant His-p53 (0.1 μM), in the presence or absence of peptide (30 μM), UBA1 (0.1 μM), UBE2D (1 μM), HDM2 (1 μM), ubiquitin (1 μM) and ATP (10 mM) (all Boston Biochem K-200B), preactivated Ub-UBEA2 (3 μM) (Boston Biochem E2-802), and USP7 (1 μM) (BostonBiochem E-519), as indicated, were mixed and incubated for 2 h at 37° C. in a final volume of 30 followed by denaturation by boiling in SDS-containing loading dye for 10 min at 90° C. Samples were resolved by agarose gel electrophoresis and transferred to nitrocellulose membrane. Membranes were blocked with 3% milk for 1 h, incubated overnight in PBS containing 3% BSA and mouse p53 antibody (Boston Biochem K-200B) at a 1:1000 dilution, washed in PBS containing 0.1% Tween-20, and then incubated in PBS containing 3% BSA and anti-mouse secondary antibody (BioRad AAC10P) at a 1:5000 dilution for 1 hour at room temperature. Membranes were again washed in PBS containing 0.1% Tween-20 and imaged using Amersham ECL Prime (GE Life Sciences) on an Amersham Imager 680 (GE Life Sciences).

Fluorescence Microscopy: His-tagged UBA1 (25 μg) was incubated with Ni-NTA agarose beads (100 μl) (Invitrogen™ $R_{90110}$) in PBS for 30 min. Beads were then incubated for 30 min with FITC-labeled peptide (10 μM). Beads were plated in 386-well plate format (10 μl/well) (Corning 384-well High Content Imaging Glass Bottom Microplate) and imaged with an Olympus wide-field epifluorescence microscope, a 63×LCPlanFL NA 0.7 objective, and a CoolSNAP DYNO camera.

Circular Dichroism: Acetylated peptides were dissolved in 10% (vol/vol) acetonitrile in water for circular dichroism analyses, performed on an Aviv Biomedical spectrophotometer, as reported (see Bird et. al., *Methods in Enzymol.*, 446:369-386 (2008)).

Peptide Proteolysis Assay: In vitro proteolytic degradation was measured by LC/MS (Agilent 1200) using the following parameters: 20 μl injection, 0.6 mL flow rate, 20-min run time consisting of a gradient of water (0.1% formic acid) to 20%-80% acetonitrile (0.75% formic acid) over 15-min, 4-min wash to revert to starting gradient conditions, and 0.5-min post-time. The MSD set to scan mode with one channel at (M+2H)/2, ±1 mass units, one channel at (M+3H)/3, ±1 mass units, and the other at (M+4H)/4, ±1 mass units. Integration of each MSD signal yielded areas under the curve of >108 counts. Reaction samples were composed of 5 µl peptide in DMSO (1 mM stock) and 195 µl buffer consisting of 50 mM Tris HCl, pH 7.4. Upon injection of the zero time sample, 6 µl of 20 ng/µL proteinase K (New England Biolabs) was added, and the amount of intact peptide quantitated by serial injection over time. A plot of MSD area versus time yielded an exponential decay curve, and half-lives were determined by nonlinear regression analysis using Prism software (GraphPad).

Example 14. UBA2-, UBA3-, and UBA6-Binding Stapled Peptides

Figure 13:
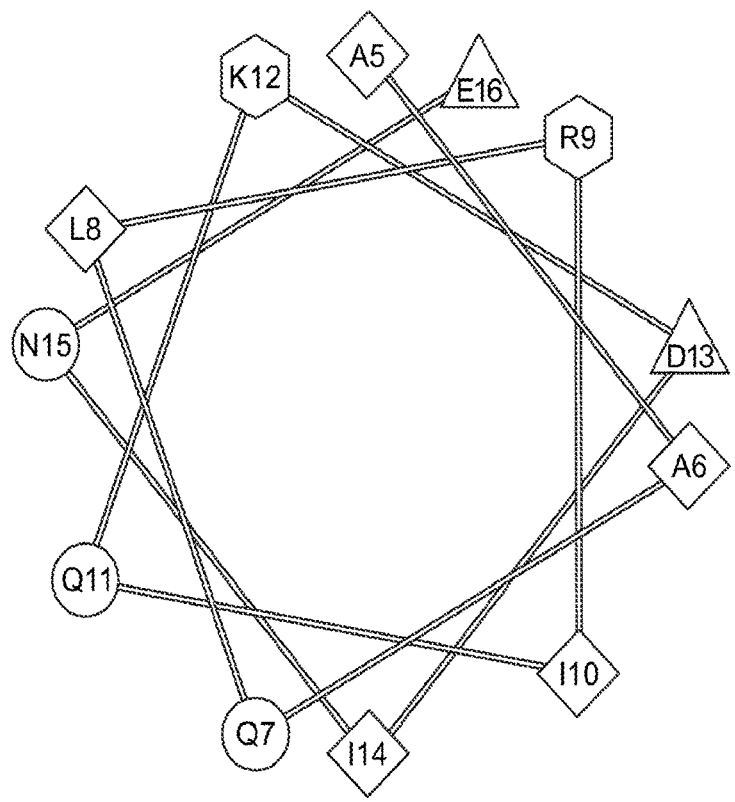
FIG. 13 illustrates a wheel depiction of the peptide portion of SEQ ID NO:36 (top panel) and SEQ ID NO:35 (bottom panel) expected to be alpha helical.
Figure 13:
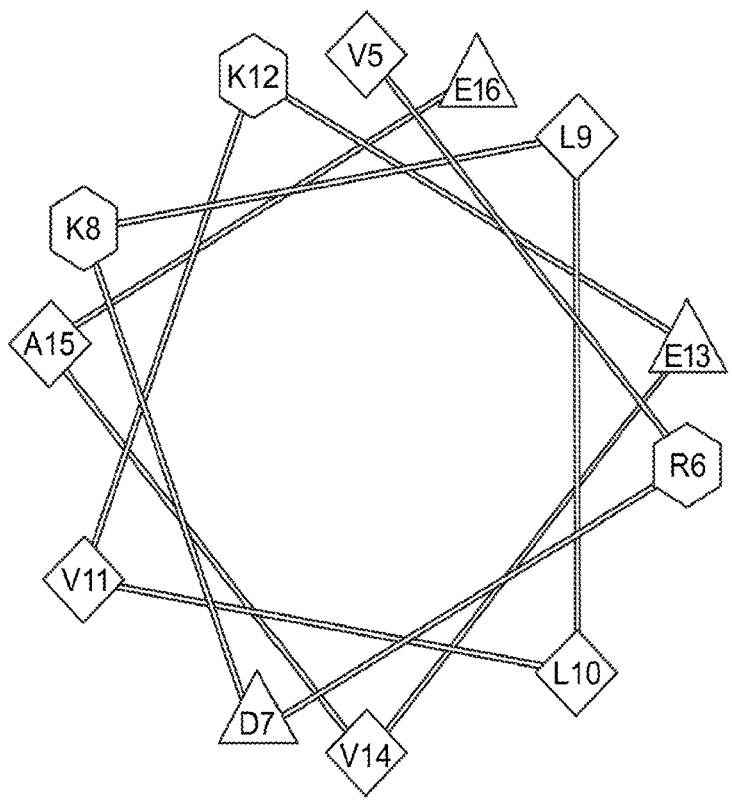
Figure 14:
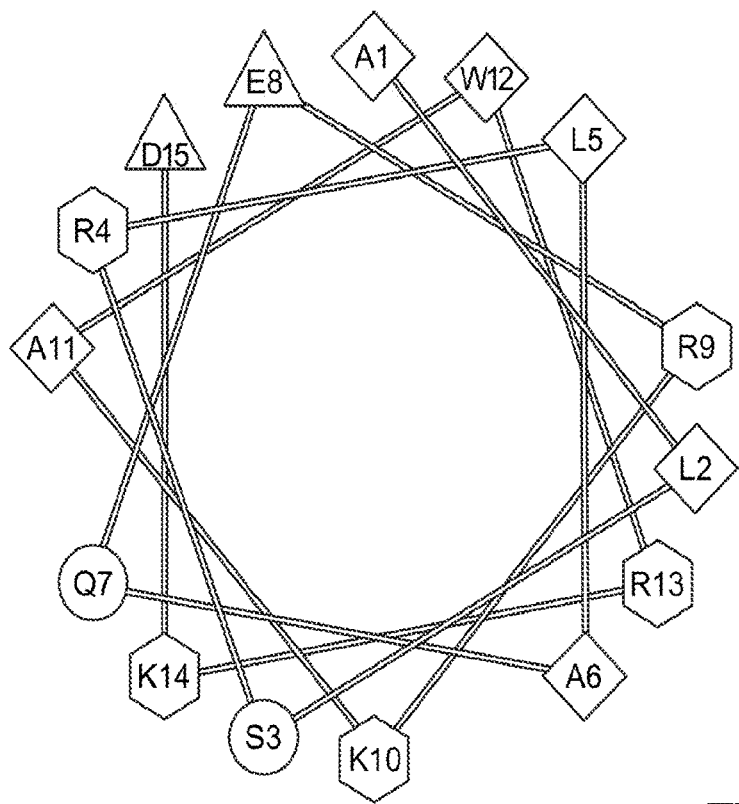
FIG. 14 illustrates a wheel depiction of the peptide portion of SEQ ID NO:37 expected to be alpha helical.
Figure 15:
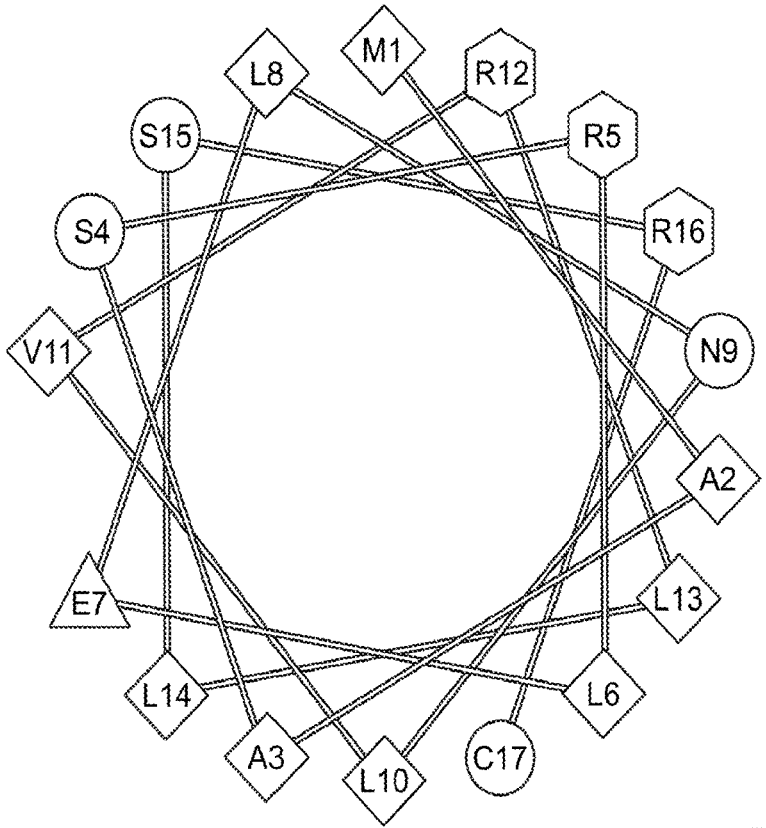
FIG. 15 illustrates a wheel depiction of the peptide portion of SEQ ID NO:38 expected to be alpha helical.

Stapled peptides binding UBA2, UBA3, and UBA6 are generated as described above. Staple scans of the UBE2F, UBE2m, UBE2I, and USE1 E2 hA peptides (SEQ ID NOs: 35-38) are performed, coupled with an assay to assess the ability of the stapled peptides to inhibit UBA2, UBA3, or UBA6 (e.g., the in vitro enzyme inhibition assay described above). FIG. 13 illustrates a wheel depiction of the peptide portion of SEQ ID NO:36 (left panel) and SEQ ID NO:35 (right panel) expected to be alpha helical. FIG. 14 illustrates a wheel depiction of the peptide portion of SEQ ID NO:37 expected to be alpha helical. FIG. 15 illustrates a wheel depiction of the peptide portion of SEQ ID NO:38 expected to be alpha helical.

Other Embodiments

While the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (1365 sequences)

SEQ ID NO: 1 - protein, 16 aa, Schizosaccharomyces pombe
MALKRINRELADLGKD

SEQ ID NO: 2 - protein, 20 aa, Schizosaccharomyces pombe
MPSSASEQLLRKQLKEIQKN

SEQ ID NO: 3 - protein, 19 aa, Homo sapiens
MANIAVQRIKREFKEVLKS

SEQ ID NO: 4 - protein, 19 aa, Homo sapiens
MSTPARRRLMRDFKRLQED

SEQ ID NO: 5 - protein, 20 aa, Homo sapiens
MTELQSALLLRRQLAELNKN

SEQ ID NO: 6 - protein, 19 aa, Homo sapiens
MAGTALKRLMAEYKQLTLN

SEQ ID NO: 7 - protein, 23 aa, Homo sapiens
MARPLVPSSQKALLLELKGLQEE

SEQ ID NO: 8 - protein, 23 aa, Homo sapiens
MAQQQMTSSQKALMLELKSLQEE

SEQ ID NO: 9 - protein, 16 aa, Homo sapiens
MALKRIQKELSDLQRD

SEQ ID NO: 10 - protein, 16 aa, Homo sapiens
MALKRIHKELNDLARD

SEQ ID NO: 11 - protein, 16 aa, Homo sapiens
MALKRINKELSDLARD

SEQ ID NO: 12 - protein, 16 aa, Homo sapiens
MALKRIQKELTDLQRD

SEQ ID NO: 13 - protein, 23 aa, Homo sapiens
KNSKLLSTSAKRIQKELADITLD

SEQ ID NO: 14 - protein, 23 aa, Homo sapiens
KTAAKLSTSAKRIQKELAEITLD

SEQ ID NO: 15 - protein, 23 aa, Homo sapiens
KTTAKLSTSAKRIQKELAEITLD

SEQ ID NO: 16 - protein, 20 aa, Homo sapiens
MHGRAYLLLHRDFCDLKENN

SEQ ID NO: 17 - protein, 25 aa, Homo sapiens
METRYNLKSPAVKRLMKEAAELKDP

SEQ ID NO: 18 - protein, 27 aa, Homo sapiens
MSSTSSKRAPTTATQRLKQDYLRIKKD

SEQ ID NO: 19 - protein, 18 aa, Homo sapiens
MAGLPRRIIKETQRLLAE

SEQ ID NO: 20 - protein, 18 aa, Homo sapiens
MAELPHRIIKETQRLLAE

SEQ ID NO: 21 - protein, 17 aa, Homo sapiens
MQRASRLKRELHMLATE

SEQ ID NO: 22 - protein, 27 aa, Homo sapiens
MAATTGSGVKVPRNFRLLEELEEGQKG

SEQ ID NO: 23 - protein, 25 aa, Homo sapiens
MAVSTGVKVPRNFRLLEELEEGQKG

SEQ ID NO: 24 - protein, 26 aa, Homo sapiens
MNSNVENLPPHIIRLVYKEVTTLTAD

SEQ ID NO: 25 - protein, 19 aa, Homo sapiens
ARGPVGKRLQQELMTLMMS

SEQ ID NO: 26 - protein, 18 aa, Homo sapiens
MASMQKRLQKELLALQND

SEQ ID NO: 27 - protein, 18 aa, Homo sapiens
AKKFFSTVRKEMALLATS

SEQ ID NO: 28 - protein, 23 aa, Homo sapiens
ANDANSAARARRLAQEAVTLSTS

SEQ ID NO: 29 - protein, 17 aa, Homo sapiens
MAASRRLMKELEEIRKC

SEQ ID NO: 30 - protein, 17 aa, Homo sapiens
MMASMRVVKELEDLQKK

SEQ ID NO: 31 - protein, 19 aa, Homo sapiens
GPFYLEYSLLAEFTLVVKQ

SEQ ID NO: 32 - protein, 23 aa, Homo sapiens
GAVSGSVQATDRLMKELRDIYRS

SEQ ID NO: 33 - protein, 23 aa, Homo sapiens
GAVSGSVQASDRLMKELRDIYRS

SEQ ID NO: 34 - protein, 21 aa, Homo sapiens
MSSPSPGKRRMDTDVVKLIES

SEQ ID NO: 35 - protein, 16 aa, Homo sapiens
RRVSVRDKLLVKEVAE

SEQ ID NO: 36 - protein, 16 aa, Homo sapiens
KKASAAQLRIQKDINE

SEQ ID NO: 37 - protein, 15 aa, Homo sapiens
ALSRLAQERKAWRKD

SEQ ID NO: 38 - protein, 17 aa, Unknown
  source: /note="Description of Unknown: UBA6-binding E2 hA peptide"
MAASRLELNLVRLLSRC

SEQ ID NO: 39 - protein, 17 aa, Artificial Sequence
  source: /note="Description of Artificial Sequence: Synthetic peptide"
MSTPARRRLMRDFKRLQ

SEQ ID NO: 40 - protein, 18 aa, Artificial Sequence
  source: /note="Description of Artificial Sequence: Synthetic peptide"
  MOD_RES (1)..(1): Norleucine
XPSSASRQLLRKQLKEIQ

SEQ ID NO: 41 - protein, 18 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (9)..(9): S-pentenyl alanine
XPSSXSRQXLRKQLKEIQ

SEQ ID NO: 42 - protein, 18 aa, Artificial Sequence
  source: /note="Description of Artificial Sequence: Synthetic peptide"
  MOD_RES (1)..(1): Norleucine
  MOD_RES (6)..(6): S-pentenyl alanine
  MOD_RES (10)..(10): S-pentenyl alanine
XPSSAXRQLXRKQLKEIQ

SEQ ID NO: 43 - protein, 18 aa, Artificial Sequence
  source: /note="Description of Artificial Sequence: Synthetic peptide"
  MOD_RES (1)..(1): Norleucine
  MOD_RES (8)..(8): S-pentenyl alanine
  MOD_RES (12)..(12): S-pentenyl alanine
XPSSASRXLLRXQLKEIQ

SEQ ID NO: 44 - protein, 18 aa, Artificial Sequence
  source: /note="Description of Artificial Sequence: Synthetic peptide"
  MOD_RES (1)..(1): Norleucine
  MOD_RES (9)..(9): S-pentenyl alanine
  MOD_RES (13)..(13): S-pentenyl alanine
XPSSASRQXLRKXLKEIQ

SEQ ID NO: 45 - protein, 18 aa, Artificial Sequence
  source: /note="Description of Artificial Sequence: Synthetic peptide"
  MOD_RES (1)..(1): Norleucine
  MOD_RES (10)..(10): S-pentenyl alanine
  MOD_RES (14)..(14): S-pentenyl alanine
XPSSASRQLXRKQXKEIQ

SEQ ID NO: 46 - protein, 18 aa, Artificial Sequence
  source: /note="Description of Artificial Sequence: Synthetic peptide"
  MOD_RES (1)..(1): Norleucine
  MOD_RES (12)..(12): S-pentenyl alanine
  MOD_RES (16)..(16): S-pentenyl alanine
XPSSASRQLLRXQLKXIQ

SEQ ID NO: 47 - protein, 18 aa, Artificial Sequence
  source: /note="Description of Artificial Sequence: Synthetic peptide"
  MOD_RES (1)..(1): Norleucine
  MOD_RES (13)..(13): S-pentenyl alanine
  MOD_RES (17)..(17): S-pentenyl alanine
XPSSASRQLLRKXLKEXQ

SEQ ID NO: 48 - protein, 18 aa, Artificial Sequence
  source: /note="Description of Artificial Sequence: Synthetic peptide"
  MOD_RES (1)..(1): Norleucine
  MOD_RES (14)..(14): S-pentenyl alanine
  MOD_RES (18)..(18): S-pentenyl alanine
XPSSASRQLLRKQXKEIX

SEQ ID NO: 49 - protein, 18 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (12)..(12): S-pentenyl alanine
XPSSXSRQLLRXQLKEIQ

SEQ ID NO: 50 - protein, 18 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (13)..(13): S-pentenyl alanine
XPSSAXRQLLRKXLKEIQ

SEQ ID NO: 51 - protein, 18 aa, Artificial Sequence
  source: /note="Description of Artificial Sequence: Synthetic peptide"
  MOD_RES (1)..(1): Norleucine
  MOD_RES (7)..(7): R-octenyl alanine
  MOD_RES (14)..(14): S-pentenyl alanine
XPSSASXQLLRKQXKEIQ

SEQ ID NO: 52 - protein, 18 aa, Artificial Sequence
  source: /note="Description of Artificial Sequence: Synthetic peptide"
  MOD_RES (1)..(1): Norleucine
  MOD_RES (8)..(8): R-octenyl alanine
  MOD_RES (15)..(15): S-pentenyl alanine
XPSSASRXLLRKQLXEIQ

SEQ ID NO: 53 - protein, 18 aa, Artificial Sequence
  source: /note="Description of Artificial Sequence: Synthetic peptide"
  MOD_RES (1)..(1): Norleucine
  MOD_RES (9)..(9): R-octenyl alanine
  MOD_RES (16)..(16): S-pentenyl alanine
XPSSASRQXLRKQLKXIQ

SEQ ID NO: 54 - protein, 18 aa, Artificial Sequence
  source: /note="Description of Artificial Sequence: Synthetic peptide"
  MOD_RES (1)..(1): Norleucine
  MOD_RES (10)..(10): R-octenyl alanine
  MOD_RES (17)..(17): S-pentenyl alanine
XPSSASRQLXRKQLKEXQ

SEQ ID NO: 55 - protein, 14 aa, Artificial Sequence
  source: /note="Description of Artificial Sequence: Synthetic peptide"
MAGTALKRLMAEYK

SEQ ID NO: 56 - protein, 20 aa, Artificial Sequence
  source: /note="Description of Artificial Sequence: Synthetic peptide"
MPSSASRQLLRKQLKEIQKN

SEQ ID NO: 57 - protein, 18 aa, Artificial Sequence
  source: /note="Description of Artificial Sequence: Synthetic peptide"
MPSSASRQLLRKQLKEIQ

SEQ ID NO: 58 - protein, 17 aa, Artificial Sequence
  source: /note="Description of Artificial Sequence: Synthetic peptide"
ASTPARRRLMRDFKRLQ

SEQ ID NO: 59 - protein, 17 aa, Artificial Sequence
  source: /note="Description of Artificial Sequence: Synthetic peptide"
MSTPARRRLMRDFRRLQ

SEQ ID NO: 60 - protein, 17 aa, Artificial Sequence
  source: /note="Description of Artificial Sequence: Synthetic peptide"
MSTPAERRLMRDFKRLQ

SEQ ID NO: 61 - protein, 17 aa, Artificial Sequence
  source: /note="Description of Artificial Sequence: Synthetic peptide"
MSTPARERLMRDFKRLQ

SEQ ID NO: 62 - protein, 17 aa, Artificial Sequence
  source: /note="Description of Artificial Sequence: Synthetic peptide"
MSTPARRELMRDFKRLQ

SEQ ID NO: 63 - protein, 17 aa, Artificial Sequence
  source: /note="Description of Artificial Sequence: Synthetic peptide"
MSTPARRRLMEDFKRLQ

SEQ ID NO: 64 - protein, 19 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (12)..(12): Any non-natural amino acid which can be covalently joined "stapled together") using a ring-closing metathesis (RCM) reaction to form a cross-linked ring
XANIXVQRIKRXFKEVLKS

SEQ ID NO: 65 - protein, 19 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (10)..(10): Norleucine
  MOD_RES (12)..(12): Any non-natural amino acid which can be covalently joined "stapled together") using a ring-closing metathesis (RCM) reaction to form a cross-linked ring
XSTPXRRRLXRXFKRLQED

SEQ ID NO: 66 - protein, 20 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (13)..(13): Any non-natural amino acid which can be covalently joined "stapled together") using a ring-closing metathesis (RCM) reaction to form a cross-linked ring
XTELQXALLLRRXLAELNKN

SEQ ID NO: 67 - protein, 19 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (10)..(10): Norleucine
  MOD_RES (12)..(12): Any non-natural amino acid which can be covalently joined "stapled together") using a ring-closing metathesis (RCM) reaction to form a cross-linked ring
XAGTXLKRLXAXYKQLTLN

SEQ ID NO: 68 - protein, 23 aa, Artificial Sequence
  source: /note="Description of Artificial Sequence: Synthetic peptide"
  MOD_RES (1)..(1): Norleucine
  MOD_RES (9)..(9): Any non-natural amino acid which can be covalently joined "stapled together") using a ring-closing metathesis (RCM) reaction to form a cross-linked ring
  MOD_RES (16)..(16): Any non-natural amino acid which can be covalently joined "stapled together") using a ring-closing metathesis (RCM) reaction to form a cross-linked ring
XARPLVPSXQKALLLXLKGLQEE

SEQ ID NO: 69 - protein, 23 aa, Artificial Sequence
  source: /note="Description of Artificial Sequence: Synthetic peptide"
  MOD_RES (1)..(1): Norleucine
  MOD_RES (6)..(6): Norleucine
  MOD_RES (9)..(9): Any non-natural amino acid which can be covalently joined "stapled together") using a ring-closing metathesis (RCM) reaction to form a cross-linked ring
  MOD_RES (14)..(14): Norleucine
  MOD_RES (16)..(16): Any non-natural amino acid which can be covalently joined "stapled together") using a ring-closing metathesis (RCM) reaction to form a cross-linked ring
XAQQQXTSXQKALXLXLKSLQEE

SEQ ID NO: 70 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (9)..(9): Any non-natural amino acid which can be covalently joined "stapled together") using a ring-closing metathesis (RCM) reaction to form a cross-linked ring
XXLKRIQKXLSDLQRD

SEQ ID NO: 71 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (9)..(9): Any non-natural amino acid which can be covalently joined "stapled together") using a ring-closing metathesis (RCM) reaction to form a cross-linked ring
XXLKRIHKXLNDLARD

SEQ ID NO: 72 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (9)..(9): Any non-natural amino acid which can be covalently joined "stapled together") using a ring-closing metathesis (RCM) reaction to form a cross-linked ring
XXLKRINKXLSDLARD

SEQ ID NO: 73 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (9)..(9): Any non-natural amino acid which can be covalently joined "stapled together") using a ring-closing metathesis (RCM) reaction to form a cross-linked ring
XXLKRIQKXLTDLQRD

SEQ ID NO: 74 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (16)..(16): Any non-natural amino acid which can be covalently joined "stapled together") using a ring-closing metathesis (RCM) reaction to form a cross-linked ring
KNSKLLSTXAKRIQKXLADITLD

SEQ ID NO: 75 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (16)..(16): Any non-natural amino acid which can be covalently joined "stapled together") using a ring-closing metathesis (RCM) reaction to form a cross-linked ring
KTAAKLSTXAKRIQKXLAEITLD

SEQ ID NO: 76 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (16)..(16): Any non-natural amino acid which can be covalently joined "stapled together") using a ring-closing metathesis (RCM) reaction to form a cross-linked ring
KTTAKLSTXAKRIQKXLAEITLD

SEQ ID NO: 77 - protein, 20 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (13)..(13): Any non-natural amino acid which can be covalently joined "stapled together") using a ring-closing metathesis (RCM) reaction to form a cross-linked ring
XHGRAXLLLHRDXCDLKENN

SEQ ID NO: 78 - protein, 25 aa, Artificial Sequence
  source: /note="Description of Artificial Sequence: Synthetic peptide"
  MOD_RES (1)..(1): Norleucine
  MOD_RES (11)..(11): Any non-natural amino acid which can be covalently joined "stapled together") using a ring-closing metathesis (RCM) reaction to form a cross-linked ring
  MOD_RES (16)..(16): Norleucine
  MOD_RES (18)..(18): Any non-natural amino acid which can be covalently joined "stapled together") using a ring-closing metathesis (RCM) reaction to form a cross-linked ring
XETRYNLKSPXVKRLXKXAAELKDP

SEQ ID NO: 79 - protein, 27 aa, Artificial Sequence
  source: /note="Description of Artificial Sequence: Synthetic peptide"
  MOD_RES (1)..(1): Norleucine
  MOD_RES (13)..(13): Any non-natural amino acid which can be covalently joined "stapled together") using a ring-closing metathesis (RCM) reaction to form a cross-linked ring
  MOD_RES (20)..(20): Any non-natural amino acid which can be covalently joined "stapled together") using a ring-closing metathesis (RCM) reaction to form a cross-linked ring
XSSTSSKRAPTTXTQRLKQXYLRIKKD

SEQ ID NO: 80 - protein, 18 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (11)..(11): Any non-natural amino acid which can be covalently joined "stapled together") using a ring-closing metathesis (RCM) reaction to form a cross-linked ring
XAGXPRRIIKXTQRLLAE

SEQ ID NO: 81 - protein, 18 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (11)..(11): Any non-natural amino acid which can be covalently joined "stapled together") using a ring-closing metathesis (RCM) reaction to form a cross-linked ring
XAEXPHRIIKXTQRLLAE

SEQ ID NO: 82 - protein, 17 aa, Artificial Sequence
  source: /note="Description of Artificial Sequence: Synthetic peptide"
  MOD_RES (1)..(1): Norleucine
  MOD_RES (3)..(3): Any non-natural amino acid which can be covalently joined "stapled together") using a ring-closing metathesis (RCM) reaction to form a cross-linked ring
  MOD_RES (10)..(10): Any non-natural amino acid which can be covalently joined "stapled together") using a ring-closing metathesis (RCM) reaction to form a cross-linked ring
  MOD_RES (13)..(13): Norleucine
XQXASRLKRXLHXLATE

SEQ ID NO: 83 - protein, 27 aa, Artificial Sequence
  source: /note="Description of Artificial Sequence: Synthetic peptide"
  MOD_RES (1)..(1): Norleucine
  MOD_RES (13)..(13): Any non-natural amino acid which can be covalently joined "stapled together") using a ring-closing metathesis (RCM) reaction to form a cross-linked ring
  MOD_RES (20)..(20): Any non-natural amino acid which can be covalently joined "stapled together") using a ring-closing metathesis (RCM) reaction to form a cross-linked ring
XAATTGSGVKVPXNFRLLEXLEEGQKG

SEQ ID NO: 84 - protein, 25 aa, Artificial Sequence
  source: /note="Description of Artificial Sequence: Synthetic peptide"
  MOD_RES (1)..(1): Norleucine
  MOD_RES (11)..(11): Any non-natural amino acid which can be covalently joined "stapled together") using a ring-closing metathesis (RCM) reaction to form a cross-linked ring
  MOD_RES (18)..(18): Any non-natural amino acid which can be covalently joined "stapled together") using a ring-closing metathesis (RCM) reaction to form a cross-linked ring
XAVSTGVKVPXNFRLLEXLEEGQKG

SEQ ID NO: 85 - protein, 26 aa, Artificial Sequence
  source: /note="Description of Artificial Sequence: Synthetic peptide"
  MOD_RES (1)..(1): Norleucine
  MOD_RES (12)..(12): Any non-natural amino acid which can be covalently joined "stapled together") using a ring-closing metathesis (RCM) reaction to form a cross-linked ring
  MOD_RES (19)..(19): Any non-natural amino acid which can be covalently joined "stapled together") using a ring-closing metathesis (RCM) reaction to form a cross-linked ring
XNSNVENLPPHXIRLVYKXVTTLTAD

SEQ ID NO: 86 - protein, 19 aa, Artificial Sequence
  source: /note="Description of Artificial Sequence: Synthetic peptide"
  MOD_RES (5)..(5): Any non-natural amino acid which can be covalently joined "stapled together") using a ring-closing metathesis (RCM) reaction to form a cross-linked ring
  MOD_RES (12)..(12): Any non-natural amino acid which can be covalently joined "stapled together") using a ring-closing metathesis (RCM) reaction to form a cross-linked ring
  MOD_RES (14)..(14): Norleucine
  MOD_RES (17)..(17): Norleucine
  MOD_RES (18)..(18): Norleucine
ARGPXGKRLQQXLXTLXXS

SEQ ID NO: 87 - protein, 18 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (11)..(11): Any non-natural amino acid which can be covalently joined "stapled together") using a ring-closing metathesis (RCM) reaction to form a cross-linked ring
XASXQKRLQKXLLALQND

SEQ ID NO: 88 - protein, 18 aa, Artificial Sequence
  source: /note="Description of Artificial Sequence: Synthetic peptide"
  MOD_RES (4)..(4): Any non-natural amino acid which can be covalently joined "stapled together") using a ring-closing metathesis (RCM) reaction to form a cross-linked ring
  MOD_RES (11)..(11): Any non-natural amino acid which can be covalently joined "stapled together") using a ring-closing metathesis (RCM) reaction to form a cross-linked ring
  MOD_RES (12)..(12): Norleucine
AKKXFSTVRKXXALLATS

SEQ ID NO: 89 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (16)..(16): Any non-natural amino acid which can be covalently joined "stapled together") using a ring-closing metathesis (RCM) reaction to form a cross-linked ring
ANDANSAAXARRLAQXAVTLSTS

SEQ ID NO: 90 - protein, 17 aa, Artificial Sequence
  source: /note="Description of Artificial Sequence: Synthetic peptide"
  MOD_RES (1)..(1): Norleucine
  MOD_RES (3)..(3): Any non-natural amino acid which can be covalently joined "stapled together") using a ring-closing metathesis (RCM) reaction to form a cross-linked ring
  MOD_RES (8)..(8): Norleucine
  MOD_RES (10)..(10): Any non-natural amino acid which can be covalently joined "stapled together") using a ring-closing metathesis (RCM) reaction to form a cross-linked ring
XAXSRRLXKXLEEIRKC

SEQ ID NO: 91 - protein, 17 aa, Artificial Sequence
  source: /note="Description of Artificial Sequence: Synthetic peptide"
  MOD_RES (1)..(1): Norleucine
  MOD_RES (2)..(2): Norleucine
  MOD_RES (3)..(3): Any non-natural amino acid which can be covalently joined "stapled together") using a ring-closing metathesis (RCM) reaction to form a cross-linked ring
  MOD_RES (5)..(5): Norleucine
  MOD_RES (10)..(10): Any non-natural amino acid which can be covalently joined "stapled together") using a ring-closing metathesis (RCM) reaction to form a cross-linked ring
XXXSXRVVKXLEDLQKK

SEQ ID NO: 92 - protein, 19 aa, Artificial Sequence
  source: /note="Description of Artificial Sequence: Synthetic peptide"
  MOD_RES (5)..(5): Any non-natural amino acid which can be covalently joined "stapled together") using a ring-closing metathesis (RCM) reaction to form a cross-linked ring
  MOD_RES (12)..(12): Any non-natural amino acid which can be covalently joined "stapled together") using a ring-closing metathesis (RCM) reaction to form a cross-linked ring
GPFYXEYSLLAXFTLVVKQ

SEQ ID NO: 93 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (14)..(14): Norleucine
  MOD_RES (16)..(16): Any non-natural amino acid which can be covalently joined "stapled together") using a ring-closing metathesis (RCM) reaction to form a cross-linked ring
GAVSGSVQXTDRLXKXLRDIYRS

SEQ ID NO: 94 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (14)..(14): Norleucine
  MOD_RES (16)..(16): Any non-natural amino acid which can be covalently joined "stapled together") using a ring-closing metathesis (RCM) reaction to form a cross-linked ring
GAVSGSVQXSDRLXKXLRDIYRS

SEQ ID NO: 95 - protein, 21 aa, Artificial Sequence
  source: /note="Description of Artificial Sequence: Synthetic peptide"
  MOD_RES (1)..(1): Norleucine
  MOD_RES (7)..(7): Any non-natural amino acid which can be covalently joined "stapled together") using a ring-closing metathesis (RCM) reaction to form a cross-linked ring
  MOD_RES (11)..(11): Norleucine
  MOD_RES (14)..(14): Any non-natural amino acid which can be covalently joined "stapled together") using a ring-closing metathesis (RCM) reaction to form a cross-linked ring
XSSPSPXKRRXDTXVVKLIES

SEQ ID NO: 96 - protein, 17 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (10)..(10): Norleucine
  MOD_RES (12)..(12): Any non-natural amino acid which can be covalently joined "stapled together") using a ring-closing metathesis (RCM) reaction to form a cross-linked ring
XSTPXRRRLXRXFKRLQ

SEQ ID NO: 97 - protein, 14 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (10)..(10): Norleucine
  MOD_RES (12)..(12): Any non-natural amino acid which can be covalently joined "stapled together") using a ring-closing metathesis (RCM) reaction to form a cross-linked ring
XAGTXLKRLXAXYK

SEQ ID NO: 98 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (9)..(9): Any non-natural amino acid which can be covalently joined "stapled together") using a ring-closing metathesis (RCM) reaction to form a cross-linked ring
XXLKRINRXLADLGKD

SEQ ID NO: 99 - protein, 20 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (13)..(13): Any non-natural amino acid which can be covalently joined "stapled together") using a ring-closing metathesis (RCM) reaction to form a cross-linked ring
XPSSAXEQLLRKXLKEIQKN

SEQ ID NO: 100 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (12)..(12): S-pentenyl alanine
XANIXVQRIKRXFKEVLKS

SEQ ID NO: 101 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRRRLXRXFKRLQED

SEQ ID NO: 102 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (13)..(13): S-pentenyl alanine
XTELQXALLLRRXLAELNKN

SEQ ID NO: 103 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XAGTXLKRLXAXYKQLTLN

SEQ ID NO: 104 - protein, 23 aa, Artificial Sequence
  source: /note="Description of Artificial Sequence: Synthetic peptide"
  MOD_RES (1)..(1): Norleucine
  MOD_RES (9)..(9): R-octenyl alanine
  MOD_RES (16)..(16): S-pentenyl alanine
XARPLVPSXQKALLLXLKGLQEE

SEQ ID NO: 105 - protein, 23 aa, Artificial Sequence
  source: /note="Description of Artificial Sequence: Synthetic peptide"
  MOD_RES (1)..(1): Norleucine
  MOD_RES (6)..(6): Norleucine
  MOD_RES (9)..(9): R-octenyl alanine
  MOD_RES (14)..(14): Norleucine
  MOD_RES (16)..(16): S-pentenyl alanine
XAQQQXTSXQKALXLXLKSLQEE

SEQ ID NO: 106 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (9)..(9): S-pentenyl alanine
XXLKRIQKXLSDLQRD

SEQ ID NO: 107 - protein, 16 aa, Artificial Sequence
  source: /note="Description of Artificial Sequence: Synthetic peptide"
  MOD_RES (1)..(1): Norleucine
  MOD_RES (2)..(2): S-pentenyl alanine or R-octenyl alanine
  MOD_RES (9)..(9): S-pentenyl alanine or R-octenyl alanine
  source: /note="See specification as filed for detailed description of substitutions and preferred embodiments"
XXLKRIHKXLNDLARD

SEQ ID NO: 108 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (9)..(9): S-pentenyl alanine
XXLKRINKXLSDLARD

SEQ ID NO: 109 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (9)..(9): S-pentenyl alanine
XXLKRIQKXLTDLQRD

SEQ ID NO: 110 - protein, 23 aa, Artificial Sequence
  source: /note="Description of Artificial Sequence: Synthetic peptide"
  MOD_RES (9)..(9): R-octenyl alanine
  MOD_RES (16)..(16): S-pentenyl alanine
KNSKLLSTXAKRIQKXLADITLD

SEQ ID NO: 111 - protein, 23 aa, Artificial Sequence
  source: /note="Description of Artificial Sequence: Synthetic peptide"
  MOD_RES (9)..(9): R-octenyl alanine
  MOD_RES (16)..(16): S-pentenyl alanine
KTAAKLSTXAKRIQKXLAEITLD

SEQ ID NO: 112 - protein, 23 aa, Artificial Sequence
  source: /note="Description of Artificial Sequence: Synthetic peptide"
  MOD_RES (9)..(9): R-octenyl alanine
  MOD_RES (16)..(16): S-pentenyl alanine
KTTAKLSTXAKRIQKXLAEITLD

SEQ ID NO: 113 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (13)..(13): S-pentenyl alanine
XHGRAXLLLHRDXCDLKENN

SEQ ID NO: 114 - protein, 25 aa, Artificial Sequence
  source: /note="Description of Artificial Sequence: Synthetic peptide"
  MOD_RES (1)..(1): Norleucine
  MOD_RES (11)..(11): R-octenyl alanine
  MOD_RES (16)..(16): Norleucine
  MOD_RES (18)..(18): S-pentenyl alanine
XETRYNLKSPXVKRLXKXAAELKDP

SEQ ID NO: 115 - protein, 27 aa, Artificial Sequence
  source: /note="Description of Artificial Sequence: Synthetic peptide"
  MOD_RES (1)..(1): Norleucine
  MOD_RES (13)..(13): R-octenyl alanine
  MOD_RES (20)..(20): S-pentenyl alanine
XSSTSSKRAPTTXTQRLKQXYLRIKKD

SEQ ID NO: 116 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (11)..(11): S-pentenyl alanine
XAGXPRRIIKXTQRLLAE

SEQ ID NO: 117 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (11)..(11): S-pentenyl alanine
XAEXPHRIIKXTQRLLAE

SEQ ID NO: 118 - protein, 17 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (10)..(10): S-pentenyl alanine
  MOD_RES (13)..(13): Norleucine
XQXASRLKRXLHXLATE

SEQ ID NO: 119 - protein, 27 aa, Artificial Sequence
  source: /note="Description of Artificial Sequence: Synthetic peptide"
  MOD_RES (1)..(1): Norleucine
  MOD_RES (13)..(13): R-octenyl alanine
  MOD_RES (20)..(20): S-pentenyl alanine
XAATTGSGVKVPXNFRLLEXLEEGQKG

SEQ ID NO: 120 - protein, 25 aa, Artificial Sequence
  source: /note="Description of Artificial Sequence: Synthetic peptide"
  MOD_RES (1)..(1): Norleucine
  MOD_RES (11)..(11): R-octenyl alanine
  MOD_RES (18)..(18): S-pentenyl alanine
XAVSTGVKVPXNFRLLEXLEEGQKG

SEQ ID NO: 121 - protein, 26 aa, Artificial Sequence
  source: /note="Description of Artificial Sequence: Synthetic peptide"
  MOD_RES (1)..(1): Norleucine
  MOD_RES (12)..(12): R-octenyl alanine
  MOD_RES (19)..(19): S-pentenyl alanine
XNSNVENLPPHXIRLVYKXVTTLTAD

SEQ ID NO: 122 - protein, 19 aa, Artificial Sequence
  source: /note="Description of Artificial Sequence: Synthetic peptide"
  MOD_RES (5)..(5): R-octenyl alanine
  MOD_RES (12)..(12): S-pentenyl alanine
  MOD_RES (14)..(14): Norleucine
  MOD_RES (17)..(17): Norleucine
  MOD_RES (18)..(18): Norleucine
ARGPXGKRLQQXLXTLXXS

SEQ ID NO: 123 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (11)..(11): S-pentenyl alanine
XASXQKRLQKXLLALQND

SEQ ID NO: 124 - protein, 18 aa, Artificial Sequence
  source: /note="Description of Artificial Sequence: Synthetic peptide"
  MOD_RES (4)..(4): R-octenyl alanine
  MOD_RES (11)..(11): S-pentenyl alanine
  MOD_RES (12)..(12): Norleucine
AKKXFSTVRKXXALLATS

SEQ ID NO: 125 - protein, 23 aa, Artificial Sequence
  source: /note="Description of Artificial Sequence: Synthetic peptide"
  MOD_RES (9)..(9): R-octenyl alanine
  MOD_RES (16)..(16): S-pentenyl alanine
ANDANSAAXARRLAQXAVTLSTS

SEQ ID NO: 126 - protein, 17 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (8)..(8): Norleucine
  MOD_RES (10)..(10): S-pentenyl alanine
XAXSRRLXKXLEEIRKC

SEQ ID NO: 127 - protein, 17 aa, Artificial Sequence
  source: /note="Description of Artificial Sequence: Synthetic peptide"
  MOD_RES (1)..(1): Norleucine
  MOD_RES (2)..(2): Norleucine
  MOD_RES (3)..(3): R-octenyl alanine
  MOD_RES (5)..(5): Norleucine
  MOD_RES (10)..(10): S-pentenyl alanine
XXXSXRVVKXLEDLQKK

SEQ ID NO: 128 - protein, 19 aa, Artificial Sequence
  source: /note="Description of Artificial Sequence: Synthetic peptide"
  MOD_RES (5)..(5): R-octenyl alanine
  MOD_RES (12)..(12): S-pentenyl alanine
GPFYXEYSLLAXFTLVVKQ

SEQ ID NO: 129 - protein, 23 aa, Artificial Sequence
  source: /note="Description of Artificial Sequence: Synthetic peptide"
  MOD_RES (9)..(9): R-octenyl alanine
  MOD_RES (14)..(14): Norleucine
  MOD_RES (16)..(16): S-pentenyl alanine
GAVSGSVQXTDRLXKXLRDIYRS

SEQ ID NO: 130 - protein, 23 aa, Artificial Sequence
  source: /note="Description of Artificial Sequence: Synthetic peptide"
  MOD_RES (9)..(9): R-octenyl alanine
  MOD_RES (14)..(14): Norleucine
  MOD_RES (16)..(16): S-pentenyl alanine
GAVSGSVQXSDRLXKXLRDIYRS

SEQ ID NO: 131 - protein, 21 aa, Artificial Sequence
  source: /note="Description of Artificial Sequence: Synthetic peptide"
  MOD_RES (1)..(1): Norleucine
  MOD_RES (7)..(7): R-octenyl alanine
  MOD_RES (11)..(11): Norleucine
  MOD_RES (14)..(14): S-pentenyl alanine
XSSPSPXKRRXDTXVVKLIES

SEQ ID NO: 132 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine or R-octenyl alanine
  MOD_RES (10)..(10): Norleucine
  MOD_RES (12)..(12): S-pentenyl alanine or R-octenyl alanine
  source: /note="See specification as filed for detailed description of substitutions and preferred embodiments"
XSTPXRRRLXRXFKRLQ

SEQ ID NO: 133 - protein, 14 aa, Artificial Sequence
  source: /note="Description of Artificial Sequence: Synthetic peptide"
  MOD_RES (1)..(1): Norleucine
  MOD_RES (5)..(5): S-pentenyl alanine or R-octenyl alanine
  MOD_RES (10)..(10): Norleucine
  MOD_RES (12)..(12): S-pentenyl alanine or R-octenyl alanine
  source: /note="See specification as filed for detailed description of substitutions and preferred embodiments"
XAGTXLKRLXAXYK

SEQ ID NO: 134 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (9)..(9): S-pentenyl alanine
XXLKRINRXLADLGKD

SEQ ID NO: 135 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (13)..(13): S-pentenyl alanine
XPSSAXEQLLRKXLKEIQKN

SEQ ID NO: 136 - protein, 16 aa, Artificial Sequence
  source: /note="Description of Artificial Sequence: Synthetic peptide"
  MOD_RES (6)..(6): Any non-natural amino acid which can be covalently joined "stapled together") using a ring-closing metathesis (RCM) reaction to form a cross-linked ring
  MOD_RES (13)..(13): Any non-natural amino acid which can be covalently joined "stapled together") using a ring-closing metathesis (RCM) reaction to form a cross-linked ring
RRVSVXDKLLVKXVAE

SEQ ID NO: 137 - protein, 16 aa, Artificial Sequence
  source: /note="Description of Artificial Sequence: Synthetic peptide"
  MOD_RES (6)..(6): Any non-natural amino acid which can be covalently joined "stapled together") using a ring-closing metathesis (RCM) reaction to form a cross-linked ring
  MOD_RES (13)..(13): Any non-natural amino acid which can be covalently joined "stapled together") using a ring-closing metathesis (RCM) reaction to form a cross-linked ring
KKASAXQLRIQKXINE

SEQ ID NO: 138 - protein, 15 aa, Artificial Sequence
  source: /note="Description of Artificial Sequence: Synthetic peptide"
  MOD_RES (5)..(5): Any non-natural amino acid which can be covalently joined "stapled together") using a ring-closing metathesis (RCM) reaction to form a cross-linked ring
  MOD_RES (12)..(12): Any non-natural amino acid which can be covalently joined "stapled together") using a ring-closing metathesis (RCM) reaction to form a cross-linked ring
ALSRXAQERKAXRKD

SEQ ID NO: 139 - protein, 17 aa, Artificial Sequence
  source: /note="Description of Artificial Sequence: Synthetic peptide"
  MOD_RES (1)..(1): Norleucine
  MOD_RES (3)..(3): Any non-natural amino acid which can be covalently joined "stapled together") using a ring-closing metathesis (RCM) reaction to form a cross-linked ring
  MOD_RES (10)..(10): Any non-natural amino acid which can be covalently joined "stapled together") using a ring-closing metathesis (RCM) reaction to form a cross-linked ring
XAXSRLELNXVRLLSRC

SEQ ID NO: 140 - protein, 16 aa, Artificial Sequence
  source: /note="Description of Artificial Sequence: Synthetic peptide"
  MOD_RES (6)..(6): R-octenyl alanine
  MOD_RES (13)..(13): S-pentenyl alanine
RRVSVXDKLLVKXVAE

SEQ ID NO: 141 - protein, 16 aa, Artificial Sequence
  source: /note="Description of Artificial Sequence: Synthetic peptide"
  MOD_RES (6)..(6): R-octenyl alanine
  MOD_RES (13)..(13): S-pentenyl alanine
KKASAXQLRIQKXINE

SEQ ID NO: 142 - protein, 15 aa, Artificial Sequence
  source: /note="Description of Artificial Sequence: Synthetic peptide"
  MOD_RES (5)..(5): R-octenyl alanine
  MOD_RES (12)..(12): S-pentenyl alanine
ALSRXAQERKAXRKD

SEQ ID NO: 143 - protein, 17 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (10)..(10): S-pentenyl alanine
XAXSRLELNXVRLLSRC

SEQ ID NO: 144 - protein, 19 aa, Artificial Sequence
  source: /note="Description of Artificial Sequence: Synthetic peptide"
  MOD_RES (10)..(10): Non-natural electrophile containing amino acid or absent
MANIAVQRIXREFKEVLKS

SEQ ID NO: 145 - protein, 19 aa, Artificial Sequence
  source: /note="Description of Artificial Sequence: Synthetic peptide"
  MOD_RES (10)..(10): Non-natural electrophile containing amino acid or absent
MSTPARRRLXRDFKRLQED

SEQ ID NO: 146 - protein, 20 aa, Artificial Sequence
  source: /note="Description of Artificial Sequence: Synthetic peptide"
  MOD_RES (11)..(11): Non-natural electrophile containing amino acid or absent
MTELQSALLLXRQLAELNKN

SEQ ID NO: 147 - protein, 19 aa, Artificial Sequence
  source: /note="Description of Artificial Sequence: Synthetic peptide"
  MOD_RES (10)..(10): Non-natural electrophile containing amino acid or absent
MAGTALKRLXAEYKQLTLN

SEQ ID NO: 148 - protein, 23 aa, Artificial Sequence
  source: /note="Description of Artificial Sequence: Synthetic peptide"
  MOD_RES (14)..(14): Non-natural electrophile containing amino acid or absent
MARPLVPSSQKALXLELKGLQEE

SEQ ID NO: 149 - protein, 23 aa, Artificial Sequence
  source: /note="Description of Artificial Sequence: Synthetic peptide"
  MOD_RES (14)..(14): Non-natural electrophile containing amino acid or absent
MAQQQMTSSQKALXLELKSLQEE

SEQ ID NO: 150 - protein, 16 aa, Artificial Sequence
  source: /note="Description of Artificial Sequence: Synthetic peptide"
  MOD_RES (7)..(7): Non-natural electrophile containing amino acid or absent
MALKRIXKELSDLQRD

SEQ ID NO: 151 - protein, 16 aa, Artificial Sequence
  source: /note="Description of Artificial Sequence: Synthetic peptide"
  MOD_RES (7)..(7): Non-natural electrophile containing amino acid or absent
MALKRIXKELNDLARD

SEQ ID NO: 152 - protein, 16 aa, Artificial Sequence
  source: /note="Description of Artificial Sequence: Synthetic peptide"
  MOD_RES (7)..(7): Non-natural electrophile containing amino acid or absent
MALKRIXKELSDLARD

SEQ ID NO: 153 - protein, 16 aa, Artificial Sequence
  source: /note="Description of Artificial Sequence: Synthetic peptide"
  MOD_RES (7)..(7): Non-natural electrophile containing amino acid or absent
MALKRIXKELTDLQRD

SEQ ID NO: 154 - protein, 23 aa, Artificial Sequence
  source: /note="Description of Artificial Sequence: Synthetic peptide"
  MOD_RES (14)..(14): Non-natural electrophile containing amino acid or absent
KNSKLLSTSAKRIXKELADITLD

SEQ ID NO: 155 - protein, 23 aa, Artificial Sequence
  source: /note="Description of Artificial Sequence: Synthetic peptide"
  MOD_RES (14)..(14): Non-natural electrophile containing amino acid or absent
KTAAKLSTSAKRIXKELAEITLD

SEQ ID NO: 156 - protein, 23 aa, Artificial Sequence
  source: /note="Description of Artificial Sequence: Synthetic peptide"
  MOD_RES (14)..(14): Non-natural electrophile containing amino acid or absent
KTTAKLSTSAKRIXKELAEITLD

SEQ ID NO: 157 - protein, 20 aa, Artificial Sequence
  source: /note="Description of Artificial Sequence: Synthetic peptide"
  MOD_RES (11)..(11): Non-natural electrophile containing amino acid or absent
MHGRAYLLLHXDFCDLKENN

SEQ ID NO: 158 - protein, 25 aa, Artificial Sequence
  source: /note="Description of Artificial Sequence: Synthetic peptide"
  MOD_RES (16)..(16): Non-natural electrophile containing amino acid or absent
METRYNLKSPAVKRLXKEAAELKDP

SEQ ID NO: 159 - protein, 27 aa, Artificial Sequence
  source: /note="Description of Artificial Sequence: Synthetic peptide"
  MOD_RES (18)..(18): Non-natural electrophile containing amino acid or absent
MSSTSSKRAPTTATQRLXQDYLRIKKD

SEQ ID NO: 160 - protein, 18 aa, Artificial Sequence
  source: /note="Description of Artificial Sequence: Synthetic peptide"
  MOD_RES (9)..(9): Non-natural electrophile containing amino acid or absent
MAGLPRRIXKETQRLLAE

SEQ ID NO: 161 - protein, 18 aa, Artificial Sequence
  source: /note="Description of Artificial Sequence: Synthetic peptide"
  MOD_RES (9)..(9): Non-natural electrophile containing amino acid or absent
MAELPHRIXKETQRLLAE

SEQ ID NO: 162 - protein, 17 aa, Artificial Sequence
  source: /note="Description of Artificial Sequence: Synthetic peptide"
  MOD_RES (8)..(8): Non-natural electrophile containing amino acid or absent
MQRASRLXRELHMLATE

SEQ ID NO: 163 - protein, 27 aa, Artificial Sequence
  source: /note="Description of Artificial Sequence: Synthetic peptide"
  MOD_RES (18)..(18): Non-natural electrophile containing amino acid or absent
MAATTGSGVKVPRNFRLXEELEEGQKG

SEQ ID NO: 164 - protein, 25 aa, Artificial Sequence
  source: /note="Description of Artificial Sequence: Synthetic peptide"
  MOD_RES (16)..(16): Non-natural electrophile containing amino acid or absent
MAVSTGVKVPRNFRLXEELEEGQKG

SEQ ID NO: 165 - protein, 26 aa, Artificial Sequence
  source: /note="Description of Artificial Sequence: Synthetic peptide"
  MOD_RES (17)..(17): Non-natural electrophile containing amino acid or absent
MNSNVENLPPHIIRLVXKEVTTLTAD

SEQ ID NO: 166 - protein, 19 aa, Artificial Sequence
  source: /note="Description of Artificial Sequence: Synthetic peptide"
  MOD_RES (10)..(10): Non-natural electrophile containing amino acid or absent
ARGPVGKRLXQELMTLMMS

SEQ ID NO: 167 - protein, 18 aa, Artificial Sequence
  source: /note="Description of Artificial Sequence: Synthetic peptide"
  MOD_RES (9)..(9): Non-natural electrophile containing amino acid or absent
MASMQKRLXKELLALQND

SEQ ID NO: 168 - protein, 18 aa, Artificial Sequence
  source: /note="Description of Artificial Sequence: Synthetic peptide"
  MOD_RES (9)..(9): Non-natural electrophile containing amino acid or absent
AKKFFSTVXKEMALLATS

SEQ ID NO: 169 - protein, 23 aa, Artificial Sequence
  source: /note="Description of Artificial Sequence: Synthetic peptide"
  MOD_RES (14)..(14): Non-natural electrophile containing amino acid or absent
ANDANSAARARRLXQEAVTLSTS

SEQ ID NO: 170 - protein, 17 aa, Artificial Sequence
  source: /note="Description of Artificial Sequence: Synthetic peptide"
  MOD_RES (8)..(8): Non-natural electrophile containing amino acid or absent
MAASRRLXKELEEIRKC

SEQ ID NO: 171 - protein, 17 aa, Artificial Sequence
  source: /note="Description of Artificial Sequence: Synthetic peptide"
  MOD_RES (8)..(8): Non-natural electrophile containing amino acid or absent
MMASMRVXKELEDLQKK

SEQ ID NO: 172 - protein, 19 aa, Artificial Sequence
  source: /note="Description of Artificial Sequence: Synthetic peptide"
  MOD_RES (10)..(10): Non-natural electrophile containing amino acid or absent
GPFYLEYSLXAEFTLVVKQ

SEQ ID NO: 173 - protein, 23 aa, Artificial Sequence
  source: /note="Description of Artificial Sequence: Synthetic peptide"
  MOD_RES (14)..(14): Non-natural electrophile containing amino acid or absent
GAVSGSVQATDRLXKELRDIYRS

SEQ ID NO: 174 - protein, 23 aa, Artificial Sequence
  source: /note="Description of Artificial Sequence: Synthetic peptide"
  MOD_RES (14)..(14): Non-natural electrophile containing amino acid or absent
GAVSGSVQASDRLXKELRDIYRS

SEQ ID NO: 175 - protein, 21 aa, Artificial Sequence
  source: /note="Description of Artificial Sequence: Synthetic peptide"
  MOD_RES (12)..(12): Non-natural electrophile containing amino acid or absent
MSSPSPGKRRMXTDVVKLIES

SEQ ID NO: 176 - protein, 17 aa, Artificial Sequence
  source: /note="Description of Artificial Sequence: Synthetic peptide"
  MOD_RES (10)..(10): Non-natural electrophile containing amino acid or absent
MSTPARRRLXRDFKRLQ

SEQ ID NO: 177 - protein, 14 aa, Artificial Sequence
  source: /note="Description of Artificial Sequence: Synthetic peptide"
  MOD_RES (10)..(10): Non-natural electrophile containing amino acid or absent
MAGTALKRLXAEYK

SEQ ID NO: 178 - protein, 16 aa, Artificial Sequence
  source: /note="Description of Artificial Sequence: Synthetic peptide"
  MOD_RES (7)..(7): Non-natural electrophile containing amino acid or absent
MALKRIXRELADLGKD

SEQ ID NO: 179 - protein, 20 aa, Artificial Sequence
  source: /note="Description of Artificial Sequence: Synthetic peptide"
  MOD_RES (11)..(11): Non-natural electrophile containing amino acid or absent
MPSSASEQLLXKQLKEIQKN

SEQ ID NO: 180 - protein, 19 aa, Artificial Sequence
  source: /note="Description of Artificial Sequence: Synthetic peptide"
  MOD_RES (11)..(11): Non-natural electrophile containing amino acid or absent
MANIAVQRIKXEFKEVLKS

SEQ ID NO: 181 - protein, 19 aa, Artificial Sequence
  source: /note="Description of Artificial Sequence: Synthetic peptide"
  MOD_RES (11)..(11): Non-natural electrophile containing amino acid or absent
MSTPARRRLMXDFKRLQED

SEQ ID NO: 182 - protein, 20 aa, Artificial Sequence
  source: /note="Description of Artificial Sequence: Synthetic peptide"
  MOD_RES (12)..(12): Non-natural electrophile containing amino acid or absent
MTELQSALLLRXQLAELNKN

SEQ ID NO: 183 - protein, 19 aa, Artificial Sequence
  source: /note="Description of Artificial Sequence: Synthetic peptide"
  MOD_RES (11)..(11): Non-natural electrophile containing amino acid or absent
MAGTALKRLMXEYKQLTLN

SEQ ID NO: 184 - protein, 23 aa, Artificial Sequence
  source: /note="Description of Artificial Sequence: Synthetic peptide"
  MOD_RES (15)..(15): Non-natural electrophile containing amino acid or absent
MARPLVPSSQKALLXELKGLQEE

SEQ ID NO: 185 - protein, 23 aa, Artificial Sequence
  source: /note="Description of Artificial Sequence: Synthetic peptide"
  MOD_RES (15)..(15): Non-natural electrophile containing amino acid or absent
MAQQQMTSSQKALMXELKSLQEE

SEQ ID NO: 186 - protein, 16 aa, Artificial Sequence
  source: /note="Description of Artificial Sequence: Synthetic peptide"
  MOD_RES (8)..(8): Non-natural electrophile containing amino acid or absent
MALKRIQXELSDLQRD

SEQ ID NO: 187 - protein, 16 aa, Artificial Sequence
  source: /note="Description of Artificial Sequence: Synthetic peptide"
  MOD_RES (8)..(8): Non-natural electrophile containing amino acid or absent
MALKRIHXELNDLARD

SEQ ID NO: 188 - protein, 16 aa, Artificial Sequence
  source: /note="Description of Artificial Sequence: Synthetic peptide"
  MOD_RES (8)..(8): Non-natural electrophile containing amino acid or absent
MALKRINXELSDLARD

SEQ ID NO: 189 - protein, 16 aa, Artificial Sequence
  source: /note="Description of Artificial Sequence: Synthetic peptide"
  MOD_RES (8)..(8): Non-natural electrophile containing amino acid or absent
MALKRIQXELTDLQRD

SEQ ID NO: 190 - protein, 23 aa, Artificial Sequence
  source: /note="Description of Artificial Sequence: Synthetic peptide"
  MOD_RES (15)..(15): Non-natural electrophile containing amino acid or absent
KNSKLLSTSAKRIQXELADITLD

SEQ ID NO: 191 - protein, 23 aa, Artificial Sequence
  source: /note="Description of Artificial Sequence: Synthetic peptide"
  MOD_RES (15)..(15): Non-natural electrophile containing amino acid or absent
KTAAKLSTSAKRIQXELAEITLD

SEQ ID NO: 192 - protein, 23 aa, Artificial Sequence
  source: /note="Description of Artificial Sequence: Synthetic peptide"
  MOD_RES (15)..(15): Non-natural electrophile containing amino acid or absent
KTTAKLSTSAKRIQXELAEITLD

SEQ ID NO: 193 - protein, 20 aa, Artificial Sequence
  source: /note="Description of Artificial Sequence: Synthetic peptide"
  MOD_RES (12)..(12): Non-natural electrophile containing amino acid or absent
MHGRAYLLLHRXFCDLKENN

SEQ ID NO: 194 - protein, 25 aa, Artificial Sequence
  source: /note="Description of Artificial Sequence: Synthetic peptide"
  MOD_RES (17)..(17): Non-natural electrophile containing amino acid or absent
METRYNLKSPAVKRLMXEAAELKDP

SEQ ID NO: 195 - protein, 27 aa, Artificial Sequence
  source: /note="Description of Artificial Sequence: Synthetic peptide"
  MOD_RES (19)..(19): Non-natural electrophile containing amino acid or absent
MSSTSSKRAPTTATQRLKXDYLRIKKD

SEQ ID NO: 196 - protein, 18 aa, Artificial Sequence
  source: /note="Description of Artificial Sequence: Synthetic peptide"
  MOD_RES (10)..(10): Non-natural electrophile containing amino acid or absent
MAGLPRRIIXETQRLLAE

SEQ ID NO: 197 - protein, 18 aa, Artificial Sequence
  source: /note="Description of Artificial Sequence: Synthetic peptide"
  MOD_RES (10)..(10): Non-natural electrophile containing amino acid or absent
MAELPHRIIXETQRLLAE

SEQ ID NO: 198 - protein, 17 aa, Artificial Sequence
  source: /note="Description of Artificial Sequence: Synthetic peptide"
  MOD_RES (9)..(9): Non-natural electrophile containing amino acid or absent
MQRASRLKXELHMLATE

SEQ ID NO: 199 - protein, 27 aa, Artificial Sequence
  source: /note="Description of Artificial Sequence: Synthetic peptide"
  MOD_RES (19)..(19): Non-natural electrophile containing amino acid or absent
MAATTGSGVKVPRNFRLLXELEEGQKG

SEQ ID NO: 200 - protein, 25 aa, Artificial Sequence
  source: /note="Description of Artificial Sequence: Synthetic peptide"
  MOD_RES (17)..(17): Non-natural electrophile containing amino acid or absent
MAVSTGVKVPRNFRLLXELEEGQKG

SEQ ID NO: 201 - protein, 26 aa, Artificial Sequence
  source: /note="Description of Artificial Sequence: Synthetic peptide"
  MOD_RES (18)..(18): Non-natural electrophile containing amino acid or absent
MNSNVENLPPHIIRLVYXEVTTLTAD

SEQ ID NO: 202 - protein, 19 aa, Artificial Sequence
  source: /note="Description of Artificial Sequence: Synthetic peptide"
  MOD_RES (11)..(11): Non-natural electrophile containing amino acid or absent
ARGPVGKRLQXELMTLMMS

SEQ ID NO: 203 - protein, 18 aa, Artificial Sequence
  source: /note="Description of Artificial Sequence: Synthetic peptide"
  MOD_RES (10)..(10): Non-natural electrophile containing amino acid or absent
MASMQKRLQXELLALQND

SEQ ID NO: 204 - protein, 18 aa, Artificial Sequence
  source: /note="Description of Artificial Sequence: Synthetic peptide"
  MOD_RES (10)..(10): Non-natural electrophile containing amino acid or absent
AKKFFSTVRXEMALLATS

SEQ ID NO: 205 - protein, 23 aa, Artificial Sequence
  source: /note="Description of Artificial Sequence: Synthetic peptide"
  MOD_RES (15)..(15): Non-natural electrophile containing amino acid or absent
ANDANSAARARRLAXEAVTLSTS

SEQ ID NO: 206 - protein, 17 aa, Artificial Sequence
  source: /note="Description of Artificial Sequence: Synthetic peptide"
  MOD_RES (9)..(9): Non-natural electrophile containing amino acid or absent
MAASRRLMXELEEIRKC

SEQ ID NO: 207 - protein, 17 aa, Artificial Sequence
  source: /note="Description of Artificial Sequence: Synthetic peptide"
  MOD_RES (9)..(9): Non-natural electrophile containing amino acid or absent
MMASMRVVXELEDLQKK

SEQ ID NO: 208 - protein, 19 aa, Artificial Sequence
  source: /note="Description of Artificial Sequence: Synthetic peptide"
  MOD_RES (11)..(11): Non-natural electrophile containing amino acid or absent
GPFYLEYSLLXEFTLVVKQ

SEQ ID NO: 209 - protein, 23 aa, Artificial Sequence
  source: /note="Description of Artificial Sequence: Synthetic peptide"
  MOD_RES (15)..(15): Non-natural electrophile containing amino acid or absent
GAVSGSVQATDRLMXELRDIYRS

SEQ ID NO: 210 - protein, 23 aa, Artificial Sequence
  source: /note="Description of Artificial Sequence: Synthetic peptide"
  MOD_RES (15)..(15): Non-natural electrophile containing amino acid or absent
GAVSGSVQASDRLMXELRDIYRS

SEQ ID NO: 211 - protein, 21 aa, Artificial Sequence
  source: /note="Description of Artificial Sequence: Synthetic peptide"
  MOD_RES (13)..(13): Non-natural electrophile containing amino acid or absent
MSSPSPGKRRMDXDVVKLIES

SEQ ID NO: 212 - protein, 17 aa, Artificial Sequence
  source: /note="Description of Artificial Sequence: Synthetic peptide"
  MOD_RES (11)..(11): Non-natural electrophile containing amino acid or absent
MSTPARRRLMXDFKRLQ

SEQ ID NO: 213 - protein, 14 aa, Artificial Sequence
  source: /note="Description of Artificial Sequence: Synthetic peptide"
  MOD_RES (11)..(11): Non-natural electrophile containing amino acid or absent
MAGTALKRLMXEYK

SEQ ID NO: 214 - protein, 16 aa, Artificial Sequence
  source: /note="Description of Artificial Sequence: Synthetic peptide"
  MOD_RES (8)..(8): Non-natural electrophile containing amino acid or absent
MALKRINXELADLGKD

SEQ ID NO: 215 - protein, 20 aa, Artificial Sequence
  source: /note="Description of Artificial Sequence: Synthetic peptide"
  MOD_RES (12)..(12): Non-natural electrophile containing amino acid or absent
MPSSASEQLLRXQLKEIQKN

SEQ ID NO: 216 - protein, 19 aa, Artificial Sequence
  source: /note="Description of Artificial Sequence: Synthetic peptide"
  MOD_RES (14)..(14): Non-natural electrophile containing amino acid or absent
MANIAVQRIKREFXEVLKS

SEQ ID NO: 217 - protein, 19 aa, Artificial Sequence
  source: /note="Description of Artificial Sequence: Synthetic peptide"
  MOD_RES (14)..(14): Non-natural electrophile containing amino acid or absent
MSTPARRRLMRDFXRLQED

SEQ ID NO: 218 - protein, 20 aa, Artificial Sequence
  source: /note="Description of Artificial Sequence: Synthetic peptide"
  MOD_RES (15)..(15): Non-natural electrophile containing amino acid or absent
MTELQSALLLRRQLXELNKN

SEQ ID NO: 219 - protein, 19 aa, Artificial Sequence
  source: /note="Description of Artificial Sequence: Synthetic peptide"
  MOD_RES (14)..(14): Non-natural electrophile containing amino acid or absent
MAGTALKRLMAEYXQLTLN

SEQ ID NO: 220 - protein, 23 aa, Artificial Sequence
  source: /note="Description of Artificial Sequence: Synthetic peptide"
  MOD_RES (18)..(18): Non-natural electrophile containing amino acid or absent
MARPLVPSSQKALLLELXGLQEE

SEQ ID NO: 221 - protein, 23 aa, Artificial Sequence
  source: /note="Description of Artificial Sequence: Synthetic peptide"
  MOD_RES (18)..(18): Non-natural electrophile containing amino acid or absent
MAQQQMTSSQKALMLELXSLQEE

SEQ ID NO: 222 - protein, 16 aa, Artificial Sequence
  source: /note="Description of Artificial Sequence: Synthetic peptide"
  MOD_RES (11)..(11): Non-natural electrophile containing amino acid or absent
MALKRIQKELXDLQRD

SEQ ID NO: 223 - protein, 16 aa, Artificial Sequence
  source: /note="Description of Artificial Sequence: Synthetic peptide"
  MOD_RES (11)..(11): Non-natural electrophile containing amino acid or absent
MALKRIHKELXDLARD

SEQ ID NO: 224 - protein, 16 aa, Artificial Sequence
  source: /note="Description of Artificial Sequence: Synthetic peptide"
  MOD_RES (11)..(11): Non-natural electrophile containing amino acid or absent
MALKRINKELXDLARD

SEQ ID NO: 225 - protein, 16 aa, Artificial Sequence
  source: /note="Description of Artificial Sequence: Synthetic peptide"
  MOD_RES (11)..(11): Non-natural electrophile containing amino acid or absent
MALKRIQKELXDLQRD

SEQ ID NO: 226 - protein, 23 aa, Artificial Sequence
  source: /note="Description of Artificial Sequence: Synthetic peptide"
  MOD_RES (18)..(18): Non-natural electrophile containing amino acid or absent
KNSKLLSTSAKRIQKELXDITLD

SEQ ID NO: 227 - protein, 23 aa, Artificial Sequence
  source: /note="Description of Artificial Sequence: Synthetic peptide"
  MOD_RES (18)..(18): Non-natural electrophile containing amino acid or absent
KTAAKLSTSAKRIQKELXEITLD

SEQ ID NO: 228 - protein, 23 aa, Artificial Sequence
  source: /note="Description of Artificial Sequence: Synthetic peptide"
  MOD_RES (18)..(18): Non-natural electrophile containing amino acid or absent
KTTAKLSTSAKRIQKELXEITLD

SEQ ID NO: 229 - protein, 20 aa, Artificial Sequence
  source: /note="Description of Artificial Sequence: Synthetic peptide"
  MOD_RES (15)..(15): Non-natural electrophile containing amino acid or absent
MHGRAYLLLHRDFCXLKENN

SEQ ID NO: 230 - protein, 25 aa, Artificial Sequence
  source: /note="Description of Artificial Sequence: Synthetic peptide"
  MOD_RES (20)..(20): Non-natural electrophile containing amino acid or absent
METRYNLKSPAVKRLMKEAXELKDP

SEQ ID NO: 231 - protein, 27 aa, Artificial Sequence
  source: /note="Description of Artificial Sequence: Synthetic peptide"
  MOD_RES (22)..(22): Non-natural electrophile containing amino acid or absent
MSSTSSKRAPTTATQRLKQDYXRIKKD

SEQ ID NO: 232 - protein, 18 aa, Artificial Sequence
  source: /note="Description of Artificial Sequence: Synthetic peptide"
  MOD_RES (13)..(13): Non-natural electrophile containing amino acid or absent
MAGLPRRIIKETXRLLAE

SEQ ID NO: 233 - protein, 18 aa, Artificial Sequence
  source: /note="Description of Artificial Sequence: Synthetic peptide"
  MOD_RES (13)..(13): Non-natural electrophile containing amino acid or absent
MAELPHRIIKETXRLLAE

SEQ ID NO: 234 - protein, 17 aa, Artificial Sequence
  source: /note="Description of Artificial Sequence: Synthetic peptide"
  MOD_RES (12)..(12): Non-natural electrophile containing amino acid or absent
MQRASRLKRELXMLATE

SEQ ID NO: 235 - protein, 27 aa, Artificial Sequence
  source: /note="Description of Artificial Sequence: Synthetic peptide"
  MOD_RES (22)..(22): Non-natural electrophile containing amino acid or absent
MAATTGSGVKVPRNFRLLEELXEGQKG

SEQ ID NO: 236 - protein, 25 aa, Artificial Sequence
  source: /note="Description of Artificial Sequence: Synthetic peptide"
  MOD_RES (20)..(20): Non-natural electrophile containing amino acid or absent
MAVSTGVKVPRNFRLLEELXEGQKG

SEQ ID NO: 237 - protein, 26 aa, Artificial Sequence
  source: /note="Description of Artificial Sequence: Synthetic peptide"
  MOD_RES (21)..(21): Non-natural electrophile containing amino acid or absent
MNSNVENLPPHIIRLVYKEVXTLTAD

SEQ ID NO: 238 - protein, 19 aa, Artificial Sequence
  source: /note="Description of Artificial Sequence: Synthetic peptide"
  MOD_RES (14)..(14): Non-natural electrophile containing amino acid or absent
ARGPVGKRLQQELXTLMMS

SEQ ID NO: 239 - protein, 18 aa, Artificial Sequence
  source: /note="Description of Artificial Sequence: Synthetic peptide"
  MOD_RES (13)..(13): Non-natural electrophile containing amino acid or absent
MASMQKRLQKELXALQND

SEQ ID NO: 240 - protein, 18 aa, Artificial Sequence
  source: /note="Description of Artificial Sequence: Synthetic peptide"
  MOD_RES (13)..(13): Non-natural electrophile containing amino acid or absent
AKKFFSTVRKEMXLLATS

SEQ ID NO: 241 - protein, 23 aa, Artificial Sequence
  source: /note="Description of Artificial Sequence: Synthetic peptide"
  MOD_RES (18)..(18): Non-natural electrophile containing amino acid or absent
ANDANSAARARRLAQEAXTLSTS

SEQ ID NO: 242 - protein, 17 aa, Artificial Sequence
  source: /note="Description of Artificial Sequence: Synthetic peptide"
  MOD_RES (12)..(12): Non-natural electrophile containing amino acid or absent
MAASRRLMKELXEIRKC

SEQ ID NO: 243 - protein, 17 aa, Artificial Sequence
  source: /note="Description of Artificial Sequence: Synthetic peptide"
  MOD_RES (12)..(12): Non-natural electrophile containing amino acid or absent
MMASMRVVKELXDLQKK

SEQ ID NO: 244 - protein, 19 aa, Artificial Sequence
  source: /note="Description of Artificial Sequence: Synthetic peptide"
  MOD_RES (14)..(14): Non-natural electrophile containing amino acid or absent
GPFYLEYSLLAEFXLVVKQ

SEQ ID NO: 245 - protein, 23 aa, Artificial Sequence
  source: /note="Description of Artificial Sequence: Synthetic peptide"
  MOD_RES (18)..(18): Non-natural electrophile containing amino acid or absent
GAVSGSVQATDRLMKELXDIYRS

SEQ ID NO: 246 - protein, 23 aa, Artificial Sequence
  source: /note="Description of Artificial Sequence: Synthetic peptide"
  MOD_RES (18)..(18): Non-natural electrophile containing amino acid or absent
GAVSGSVQASDRLMKELXDIYRS

SEQ ID NO: 247 - protein, 21 aa, Artificial Sequence
  source: /note="Description of Artificial Sequence: Synthetic peptide"
  MOD_RES (16)..(16): Non-natural electrophile containing amino acid or absent
MSSPSPGKRRMDTDVXKLIES

SEQ ID NO: 248 - protein, 17 aa, Artificial Sequence
  source: /note="Description of Artificial Sequence: Synthetic peptide"
  MOD_RES (14)..(14): Non-natural electrophile containing amino acid or absent
MSTPARRRLMRDFXRLQ

SEQ ID NO: 249 - protein, 14 aa, Artificial Sequence
  source: /note="Description of Artificial Sequence: Synthetic peptide"
  MOD_RES (14)..(14): Non-natural electrophile containing amino acid or absent
MAGTALKRLMAEYX

SEQ ID NO: 250 - protein, 16 aa, Artificial Sequence
  source: /note="Description of Artificial Sequence: Synthetic peptide"
  MOD_RES (11)..(11): Non-natural electrophile containing amino acid or absent
MALKRINRELXDLGKD

SEQ ID NO: 251 - protein, 20 aa, Artificial Sequence
  source: /note="Description of Artificial Sequence: Synthetic peptide"
  MOD_RES (15)..(15): Non-natural electrophile containing amino acid or absent
MPSSASEQLLRKQLXEIQKN

SEQ ID NO: 252 - protein, 19 aa, Artificial Sequence
  source: /note="Description of Artificial Sequence: Synthetic peptide"
  MOD_RES (10)..(10): Diamino butanoic acid terminating in acrylamide or diamino butanoic acid terminating in bromoacetyl
MANIAVQRIXREFKEVLKS

SEQ ID NO: 253 - protein, 19 aa, Artificial Sequence
  source: /note="Description of Artificial Sequence: Synthetic peptide"
  MOD_RES (10)..(10): Diamino butanoic acid terminating in acrylamide or diamino butanoic acid terminating in bromoacetyl
MSTPARRRLXRDFKRLQED

SEQ ID NO: 254 - protein, 20 aa, Artificial Sequence
  source: /note="Description of Artificial Sequence: Synthetic peptide"
  MOD_RES (11)..(11): Diamino butanoic acid terminating in acrylamide or diamino butanoic acid terminating in bromoacetyl
MTELQSALLLXRQLAELNKN

SEQ ID NO: 255 - protein, 19 aa, Artificial Sequence
  source: /note="Description of Artificial Sequence: Synthetic peptide"
  MOD_RES (10)..(10): Diamino butanoic acid terminating in acrylamide or diamino butanoic acid terminating in bromoacetyl
MAGTALKRLXAEYKQLTLN

SEQ ID NO: 256 - protein, 23 aa, Artificial Sequence
  source: /note="Description of Artificial Sequence: Synthetic peptide"
  MOD_RES (14)..(14): Diamino butanoic acid terminating in acrylamide or diamino butanoic acid terminating in bromoacetyl
MARPLVPSSQKALXLELKGLQEE

SEQ ID NO: 257 - protein, 23 aa, Artificial Sequence
  source: /note="Description of Artificial Sequence: Synthetic peptide"
  MOD_RES (14)..(14): Diamino butanoic acid terminating in acrylamide or diamino butanoic acid terminating in bromoacetyl
MAQQQMTSSQKALXLELKSLQEE

SEQ ID NO: 258 - protein, 16 aa, Artificial Sequence
  source: /note="Description of Artificial Sequence: Synthetic peptide"
  MOD_RES (7)..(7): Diamino butanoic acid terminating in acrylamide or diamino butanoic acid terminating in bromoacetyl
MALKRIXKELSDLQRD

SEQ ID NO: 259 - protein, 16 aa, Artificial Sequence
  source: /note="Description of Artificial Sequence: Synthetic peptide"
  MOD_RES (7)..(7): Diamino butanoic acid terminating in acrylamide or diamino butanoic acid terminating in bromoacetyl
MALKRIXKELNDLARD

SEQ ID NO: 260 - protein, 16 aa, Artificial Sequence
  source: /note="Description of Artificial Sequence: Synthetic peptide"
  MOD_RES (7)..(7): Diamino butanoic acid terminating in acrylamide or diamino butanoic acid terminating in bromoacetyl
MALKRIXKELSDLARD

SEQ ID NO: 261 - protein, 16 aa, Artificial Sequence
  source: /note="Description of Artificial Sequence: Synthetic peptide"
  MOD_RES (7)..(7): Diamino butanoic acid terminating in acrylamide or diamino butanoic acid terminating in bromoacetyl
MALKRIXKELTDLQRD

SEQ ID NO: 262 - protein, 23 aa, Artificial Sequence
  source: /note="Description of Artificial Sequence: Synthetic peptide"
  MOD_RES (14)..(14): Diamino butanoic acid terminating in acrylamide or diamino butanoic acid terminating in bromoacetyl
KNSKLLSTSAKRIXKELADITLD

SEQ ID NO: 263 - protein, 23 aa, Artificial Sequence
  source: /note="Description of Artificial Sequence: Synthetic peptide"
  MOD_RES (14)..(14): Diamino butanoic acid terminating in acrylamide or diamino butanoic acid terminating in bromoacetyl
KTAAKLSTSAKRIXKELAEITLD

SEQ ID NO: 264 - protein, 23 aa, Artificial Sequence
  source: /note="Description of Artificial Sequence: Synthetic peptide"
  MOD_RES (14)..(14): Diamino butanoic acid terminating in acrylamide or diamino butanoic acid terminating in bromoacetyl
KTTAKLSTSAKRIXKELAEITLD

SEQ ID NO: 265 - protein, 20 aa, Artificial Sequence
  source: /note="Description of Artificial Sequence: Synthetic peptide"
  MOD_RES (11)..(11): Diamino butanoic acid terminating in acrylamide or diamino butanoic acid terminating in bromoacetyl
MHGRAYLLLHXDFCDLKENN

SEQ ID NO: 266 - protein, 25 aa, Artificial Sequence
  source: /note="Description of Artificial Sequence: Synthetic peptide"
  MOD_RES (16)..(16): Diamino butanoic acid terminating in acrylamide or diamino butanoic acid terminating in bromoacetyl
METRYNLKSPAVKRLXKEAAELKDP

SEQ ID NO: 267 - protein, 27 aa, Artificial Sequence
  source: /note="Description of Artificial Sequence: Synthetic peptide"
  MOD_RES (18)..(18): Diamino butanoic acid terminating in acrylamide or diamino butanoic acid terminating in bromoacetyl
MSSTSSKRAPTTATQRLXQDYLRIKKD

SEQ ID NO: 268 - protein, 18 aa, Artificial Sequence
  source: /note="Description of Artificial Sequence: Synthetic peptide"
  MOD_RES (9)..(9): Diamino butanoic acid terminating in acrylamide or diamino butanoic acid terminating in bromoacetyl
MAGLPRRIXKETQRLLAE

SEQ ID NO: 269 - protein, 18 aa, Artificial Sequence
  source: /note="Description of Artificial Sequence: Synthetic peptide"
  MOD_RES (9)..(9): Diamino butanoic acid terminating in acrylamide or diamino butanoic acid terminating in bromoacetyl
MAELPHRIXKETQRLLAE

SEQ ID NO: 270 - protein, 17 aa, Artificial Sequence
  source: /note="Description of Artificial Sequence: Synthetic peptide"
  MOD_RES (8)..(8): Diamino butanoic acid terminating in acrylamide or diamino butanoic acid terminating in bromoacetyl
MQRASRLXRELHMLATE

SEQ ID NO: 271 - protein, 27 aa, Artificial Sequence
  source: /note="Description of Artificial Sequence: Synthetic peptide"
  MOD_RES (18)..(18): Diamino butanoic acid terminating in acrylamide or diamino butanoic acid terminating in bromoacetyl
MAATTGSGVKVPRNFRLXEELEEGQKG

SEQ ID NO: 272 - protein, 25 aa, Artificial Sequence
  source: /note="Description of Artificial Sequence: Synthetic peptide"
  MOD_RES (16)..(16): Diamino butanoic acid terminating in acrylamide or diamino butanoic acid terminating in bromoacetyl
MAVSTGVKVPRNFRLXEELEEGQKG

SEQ ID NO: 273 - protein, 26 aa, Artificial Sequence
  source: /note="Description of Artificial Sequence: Synthetic peptide"
  MOD_RES (17)..(17): Diamino butanoic acid terminating in acrylamide or diamino butanoic acid terminating in bromoacetyl
MNSNVENLPPHIIRLVXKEVTTLTAD

SEQ ID NO: 274 - protein, 19 aa, Artificial Sequence
  source: /note="Description of Artificial Sequence: Synthetic peptide"
  MOD_RES (10)..(10): Diamino butanoic acid terminating in acrylamide or diamino butanoic acid terminating in bromoacetyl
ARGPVGKRLXQELMTLMMS

SEQ ID NO: 275 - protein, 18 aa, Artificial Sequence
  source: /note="Description of Artificial Sequence: Synthetic peptide"
  MOD_RES (9)..(9): Diamino butanoic acid terminating in acrylamide or diamino butanoic acid terminating in bromoacetyl
MASMQKRLXKELLALQND

SEQ ID NO: 276 - protein, 18 aa, Artificial Sequence
  source: /note="Description of Artificial Sequence: Synthetic peptide"
  MOD_RES (9)..(9): Diamino butanoic acid terminating in acrylamide or diamino butanoic acid terminating in bromoacetyl
AKKFFSTVXKEMALLATS

SEQ ID NO: 277 - protein, 23 aa, Artificial Sequence
  source: /note="Description of Artificial Sequence: Synthetic peptide"
  MOD_RES (14)..(14): Diamino butanoic acid terminating in acrylamide or diamino butanoic acid terminating in bromoacetyl
ANDANSAARARRLXQEAVTLSTS

SEQ ID NO: 278 - protein, 17 aa, Artificial Sequence
  source: /note="Description of Artificial Sequence: Synthetic peptide"
  MOD_RES (8)..(8): Diamino butanoic acid terminating in acrylamide or diamino butanoic acid terminating in bromoacetyl
MAASRRLXKELEEIRKC

SEQ ID NO: 279 - protein, 17 aa, Artificial Sequence
  source: /note="Description of Artificial Sequence: Synthetic peptide"
  MOD_RES (8)..(8): Diamino butanoic acid terminating in acrylamide or diamino butanoic acid terminating in bromoacetyl
MMASMRVXKELEDLQKK

SEQ ID NO: 280 - protein, 19 aa, Artificial Sequence
  source: /note="Description of Artificial Sequence: Synthetic peptide"
  MOD_RES (10)..(10): Diamino butanoic acid terminating in acrylamide or diamino butanoic acid terminating in bromoacetyl
GPFYLEYSLXAEFTLVVKQ

SEQ ID NO: 281 - protein, 23 aa, Artificial Sequence
  source: /note="Description of Artificial Sequence: Synthetic peptide"
  MOD_RES (14)..(14): Diamino butanoic acid terminating in acrylamide or diamino butanoic acid terminating in bromoacetyl
GAVSGSVQATDRLXKELRDIYRS

SEQ ID NO: 282 - protein, 23 aa, Artificial Sequence
  source: /note="Description of Artificial Sequence: Synthetic peptide"
  MOD_RES (14)..(14): Diamino butanoic acid terminating in acrylamide or diamino butanoic acid terminating in bromoacetyl
GAVSGSVQASDRLXKELRDIYRS

SEQ ID NO: 283 - protein, 21 aa, Artificial Sequence
  source: /note="Description of Artificial Sequence: Synthetic peptide"
  MOD_RES (12)..(12): Diamino butanoic acid terminating in acrylamide or diamino butanoic acid terminating in bromoacetyl
MSSPSPGKRRMXTDVVKLIES

SEQ ID NO: 284 - protein, 17 aa, Artificial Sequence
  source: /note="Description of Artificial Sequence: Synthetic peptide"
  MOD_RES (10)..(10): Diamino butanoic acid terminating in acrylamide or diamino butanoic acid terminating in bromoacetyl
MSTPARRRLXRDFKRLQ

SEQ ID NO: 285 - protein, 14 aa, Artificial Sequence
  source: /note="Description of Artificial Sequence: Synthetic peptide"
  MOD_RES (10)..(10): Diamino butanoic acid terminating in acrylamide or diamino butanoic acid terminating in bromoacetyl
MAGTALKRLXAEYK

SEQ ID NO: 286 - protein, 16 aa, Artificial Sequence
  source: /note="Description of Artificial Sequence: Synthetic peptide"
  MOD_RES (7)..(7): Diamino butanoic acid terminating in acrylamide or diamino butanoic acid terminating in bromoacetyl
MALKRIXRELADLGKD

SEQ ID NO: 287 - protein, 20 aa, Artificial Sequence
  source: /note="Description of Artificial Sequence: Synthetic peptide"
  MOD_RES (11)..(11): Diamino butanoic acid terminating in acrylamide or diamino butanoic acid terminating in bromoacetyl
MPSSASEQLLXKQLKEIQKN

SEQ ID NO: 288 - protein, 19 aa, Artificial Sequence
  source: /note="Description of Artificial Sequence: Synthetic peptide"
  MOD_RES (11)..(11): Diamino butanoic acid terminating in acrylamide or diamino butanoic acid terminating in bromoacetyl
MANIAVQRIKXEFKEVLKS

SEQ ID NO: 289 - protein, 19 aa, Artificial Sequence
  source: /note="Description of Artificial Sequence: Synthetic peptide"
  MOD_RES (11)..(11): Diamino butanoic acid terminating in acrylamide or diamino butanoic acid terminating in bromoacetyl
MSTPARRRLMXDFKRLQED

SEQ ID NO: 290 - protein, 20 aa, Artificial Sequence
  source: /note="Description of Artificial Sequence: Synthetic peptide"
  MOD_RES (12)..(12): Diamino butanoic acid terminating in acrylamide or diamino butanoic acid terminating in bromoacetyl
MTELQSALLLRXQLAELNKN

SEQ ID NO: 291 - protein, 19 aa, Artificial Sequence
  source: /note="Description of Artificial Sequence: Synthetic peptide"
  MOD_RES (11)..(11): Diamino butanoic acid terminating in acrylamide or diamino butanoic acid terminating in bromoacetyl
MAGTALKRLMXEYKQLTLN

SEQ ID NO: 292 - protein, 23 aa, Artificial Sequence
  source: /note="Description of Artificial Sequence: Synthetic peptide"
  MOD_RES (15)..(15): Diamino butanoic acid terminating in acrylamide or diamino butanoic acid terminating in bromoacetyl
MARPLVPSSQKALLXELKGLQEE

SEQ ID NO: 293 - protein, 23 aa, Artificial Sequence
  source: /note="Description of Artificial Sequence: Synthetic peptide"
  MOD_RES (15)..(15): Diamino butanoic acid terminating in acrylamide or diamino butanoic acid terminating in bromoacetyl
MAQQQMTSSQKALMXELKSLQEE

SEQ ID NO: 294 - protein, 16 aa, Artificial Sequence
  source: /note="Description of Artificial Sequence: Synthetic peptide"
  MOD_RES (8)..(8): Diamino butanoic acid terminating in acrylamide or diamino butanoic acid terminating in bromoacetyl
MALKRIQXELSDLQRD

SEQ ID NO: 295 - protein, 16 aa, Artificial Sequence
  source: /note="Description of Artificial Sequence: Synthetic peptide"
  MOD_RES (8)..(8): Diamino butanoic acid terminating in acrylamide or diamino butanoic acid terminating in bromoacetyl
MALKRIHXELNDLARD

SEQ ID NO: 296 - protein, 16 aa, Artificial Sequence
  source: /note="Description of Artificial Sequence: Synthetic peptide"
  MOD_RES (8)..(8): Diamino butanoic acid terminating in acrylamide or diamino butanoic acid terminating in bromoacetyl
MALKRINXELSDLARD

SEQ ID NO: 297 - protein, 16 aa, Artificial Sequence
  source: /note="Description of Artificial Sequence: Synthetic peptide"
  MOD_RES (8)..(8): Diamino butanoic acid terminating in acrylamide or diamino butanoic acid terminating in bromoacetyl
MALKRIQXELTDLQRD

SEQ ID NO: 298 - protein, 23 aa, Artificial Sequence
  source: /note="Description of Artificial Sequence: Synthetic peptide"
  MOD_RES (15)..(15): Diamino butanoic acid terminating in acrylamide or diamino butanoic acid terminating in bromoacetyl
KNSKLLSTSAKRIQXELADITLD

SEQ ID NO: 299 - protein, 23 aa, Artificial Sequence
  source: /note="Description of Artificial Sequence: Synthetic peptide"
  MOD_RES (15)..(15): Diamino butanoic acid terminating in acrylamide or diamino butanoic acid terminating in bromoacetyl
KTAAKLSTSAKRIQXELAEITLD

SEQ ID NO: 300 - protein, 23 aa, Artificial Sequence
  source: /note="Description of Artificial Sequence: Synthetic peptide"
  MOD_RES (15)..(15): Diamino butanoic acid terminating in acrylamide or diamino butanoic acid terminating in bromoacetyl
KTTAKLSTSAKRIQXELAEITLD

SEQ ID NO: 301 - protein, 20 aa, Artificial Sequence
  source: /note="Description of Artificial Sequence: Synthetic peptide"
  MOD_RES (12)..(12): Diamino butanoic acid terminating in acrylamide or diamino butanoic acid terminating in bromoacetyl
MHGRAYLLLHRXFCDLKENN

SEQ ID NO: 302 - protein, 25 aa, Artificial Sequence
  source: /note="Description of Artificial Sequence: Synthetic peptide"
  MOD_RES (17)..(17): Diamino butanoic acid terminating in acrylamide or diamino butanoic acid terminating in bromoacetyl
METRYNLKSPAVKRLMXEAAELKDP

SEQ ID NO: 303 - protein, 27 aa, Artificial Sequence
  source: /note="Description of Artificial Sequence: Synthetic peptide"
  MOD_RES (19)..(19): Diamino butanoic acid terminating in acrylamide or diamino butanoic acid terminating in bromoacetyl
MSSTSSKRAPTTATQRLKXDYLRIKKD

SEQ ID NO: 304 - protein, 18 aa, Artificial Sequence
  source: /note="Description of Artificial Sequence: Synthetic peptide"
  MOD_RES (10)..(10): Diamino butanoic acid terminating in acrylamide or diamino butanoic acid terminating in bromoacetyl
MAGLPRRIIXETQRLLAE

SEQ ID NO: 305 - protein, 18 aa, Artificial Sequence
  source: /note="Description of Artificial Sequence: Synthetic peptide"
  MOD_RES (10)..(10): Diamino butanoic acid terminating in acrylamide or diamino butanoic acid terminating in bromoacetyl
MAELPHRIIXETQRLLAE

SEQ ID NO: 306 - protein, 17 aa, Artificial Sequence
  source: /note="Description of Artificial Sequence: Synthetic peptide"
  MOD_RES (9)..(9): Diamino butanoic acid terminating in acrylamide or diamino butanoic acid terminating in bromoacetyl
MQRASRLKXELHMLATE

SEQ ID NO: 307 - protein, 27 aa, Artificial Sequence
  source: /note="Description of Artificial Sequence: Synthetic peptide"
  MOD_RES (19)..(19): Diamino butanoic acid terminating in acrylamide or diamino butanoic acid terminating in bromoacetyl
MAATTGSGVKVPRNFRLLXELEEGQKG

SEQ ID NO: 308 - protein, 25 aa, Artificial Sequence
  source: /note="Description of Artificial Sequence: Synthetic peptide"
  MOD_RES (17)..(17): Diamino butanoic acid terminating in acrylamide or diamino butanoic acid terminating in bromoacetyl
MAVSTGVKVPRNFRLLXELEEGQKG

SEQ ID NO: 309 - protein, 26 aa, Artificial Sequence
  source: /note="Description of Artificial Sequence: Synthetic peptide"
  MOD_RES (18)..(18): Diamino butanoic acid terminating in acrylamide or diamino butanoic acid terminating in bromoacetyl
MNSNVENLPPHIIRLVYXEVTTLTAD

SEQ ID NO: 310 - protein, 19 aa, Artificial Sequence
  source: /note="Description of Artificial Sequence: Synthetic peptide"
  MOD_RES (11)..(11): Diamino butanoic acid terminating in acrylamide or diamino butanoic acid terminating in bromoacetyl
ARGPVGKRLQXELMTLMMS

SEQ ID NO: 311 - protein, 18 aa, Artificial Sequence
  source: /note="Description of Artificial Sequence: Synthetic peptide"
  MOD_RES (10)..(10): Diamino butanoic acid terminating in acrylamide or diamino butanoic acid terminating in bromoacetyl
MASMQKRLQXELLALQND

SEQ ID NO: 312 - protein, 18 aa, Artificial Sequence
  source: /note="Description of Artificial Sequence: Synthetic peptide"
  MOD_RES (10)..(10): Diamino butanoic acid terminating in acrylamide or diamino butanoic acid terminating in bromoacetyl
AKKFFSTVRXEMALLATS

SEQ ID NO: 313 - protein, 23 aa, Artificial Sequence
  source: /note="Description of Artificial Sequence: Synthetic peptide"
  MOD_RES (15)..(15): Diamino butanoic acid terminating in acrylamide or diamino butanoic acid terminating in bromoacetyl
ANDANSAARARRLAXEAVTLSTS

SEQ ID NO: 314 - protein, 17 aa, Artificial Sequence
  source: /note="Description of Artificial Sequence: Synthetic peptide"
  MOD_RES (9)..(9): Diamino butanoic acid terminating in acrylamide or diamino butanoic acid terminating in bromoacetyl
MAASRRLMXELEEIRKC

SEQ ID NO: 315 - protein, 17 aa, Artificial Sequence
  source: /note="Description of Artificial Sequence: Synthetic peptide"
  MOD_RES (9)..(9): Diamino butanoic acid terminating in acrylamide or diamino butanoic acid terminating in bromoacetyl
MMASMRVVXELEDLQKK

SEQ ID NO: 316 - protein, 19 aa, Artificial Sequence
  source: /note="Description of Artificial Sequence: Synthetic peptide"
  MOD_RES (11)..(11): Diamino butanoic acid terminating in acrylamide or diamino butanoic acid terminating in bromoacetyl
GPFYLEYSLLXEFTLVVKQ

SEQ ID NO: 317 - protein, 23 aa, Artificial Sequence
  source: /note="Description of Artificial Sequence: Synthetic peptide"
  MOD_RES (15)..(15): Diamino butanoic acid terminating in acrylamide or diamino butanoic acid terminating in bromoacetyl
GAVSGSVQATDRLMXELRDIYRS

SEQ ID NO: 318 - protein, 23 aa, Artificial Sequence
  source: /note="Description of Artificial Sequence: Synthetic peptide"
  MOD_RES (15)..(15): Diamino butanoic acid terminating in acrylamide or diamino butanoic acid terminating in bromoacetyl
GAVSGSVQASDRLMXELRDIYRS

SEQ ID NO: 319 - protein, 21 aa, Artificial Sequence
  source: /note="Description of Artificial Sequence: Synthetic peptide"
  MOD_RES (13)..(13): Diamino butanoic acid terminating in acrylamide or diamino butanoic acid terminating in bromoacetyl
MSSPSPGKRRMDXDVVKLIES

SEQ ID NO: 320 - protein, 17 aa, Artificial Sequence
  source: /note="Description of Artificial Sequence: Synthetic peptide"
  MOD_RES (11)..(11): Diamino butanoic acid terminating in acrylamide or diamino butanoic acid terminating in bromoacetyl
MSTPARRRLMXDFKRLQ

SEQ ID NO: 321 - protein, 14 aa, Artificial Sequence
  source: /note="Description of Artificial Sequence: Synthetic peptide"
  MOD_RES (11)..(11): Diamino butanoic acid terminating in acrylamide or diamino butanoic acid terminating in bromoacetyl
MAGTALKRLMXEYK

SEQ ID NO: 322 - protein, 16 aa, Artificial Sequence
  source: /note="Description of Artificial Sequence: Synthetic peptide"
  MOD_RES (8)..(8): Diamino butanoic acid terminating in acrylamide or diamino butanoic acid terminating in bromoacetyl
MALKRINXELADLGKD

SEQ ID NO: 323 - protein, 20 aa, Artificial Sequence
  source: /note="Description of Artificial Sequence: Synthetic peptide"
  MOD_RES (12)..(12): Diamino butanoic acid terminating in acrylamide or diamino butanoic acid terminating in bromoacetyl
MPSSASEQLLRXQLKEIQKN

SEQ ID NO: 324 - protein, 19 aa, Artificial Sequence
  source: /note="Description of Artificial Sequence: Synthetic peptide"
  MOD_RES (14)..(14): Diamino butanoic acid terminating in acrylamide or diamino butanoic acid terminating in bromoacetyl
MANIAVQRIKREFXEVLKS

SEQ ID NO: 325 - protein, 19 aa, Artificial Sequence
  source: /note="Description of Artificial Sequence: Synthetic peptide"
  MOD_RES (14)..(14): Diamino butanoic acid terminating in acrylamide or diamino butanoic acid terminating in bromoacetyl
MSTPARRRLMRDFXRLQED

SEQ ID NO: 326 - protein, 20 aa, Artificial Sequence
  source: /note="Description of Artificial Sequence: Synthetic peptide"
  MOD_RES (15)..(15): Diamino butanoic acid terminating in acrylamide or diamino butanoic acid terminating in bromoacetyl
MTELQSALLLRRQLXELNKN

SEQ ID NO: 327 - protein, 19 aa, Artificial Sequence
  source: /note="Description of Artificial Sequence: Synthetic peptide"
  MOD_RES (14)..(14): Diamino butanoic acid terminating in acrylamide or diamino butanoic acid terminating in bromoacetyl
MAGTALKRLMAEYXQLTLN

SEQ ID NO: 328 - protein, 23 aa, Artificial Sequence
  source: /note="Description of Artificial Sequence: Synthetic peptide"
  MOD_RES (18)..(18): Diamino butanoic acid terminating in acrylamide or diamino butanoic acid terminating in bromoacetyl
MARPLVPSSQKALLLELXGLQEE

SEQ ID NO: 329 - protein, 23 aa, Artificial Sequence
  source: /note="Description of Artificial Sequence: Synthetic peptide"
  MOD_RES (18)..(18): Diamino butanoic acid terminating in acrylamide or diamino butanoic acid terminating in bromoacetyl
MAQQQMTSSQKALMLELXSLQEE

SEQ ID NO: 330 - protein, 16 aa, Artificial Sequence
  source: /note="Description of Artificial Sequence: Synthetic peptide"
  MOD_RES (11)..(11): Diamino butanoic acid terminating in acrylamide or diamino butanoic acid terminating in bromoacetyl
MALKRIQKELXDLQRD

SEQ ID NO: 331 - protein, 16 aa, Artificial Sequence
  source: /note="Description of Artificial Sequence: Synthetic peptide"
  MOD_RES (11)..(11): Diamino butanoic acid terminating in acrylamide or diamino butanoic acid terminating in bromoacetyl
MALKRIHKELXDLARD

SEQ ID NO: 332 - protein, 16 aa, Artificial Sequence
  source: /note="Description of Artificial Sequence: Synthetic peptide"
  MOD_RES (11)..(11): Diamino butanoic acid terminating in acrylamide or diamino butanoic acid terminating in bromoacetyl
MALKRINKELXDLARD

SEQ ID NO: 333 - protein, 16 aa, Artificial Sequence
  source: /note="Description of Artificial Sequence: Synthetic peptide"
  MOD_RES (11)..(11): Diamino butanoic acid terminating in acrylamide or diamino butanoic acid terminating in bromoacetyl
MALKRIQKELXDLQRD

SEQ ID NO: 334 - protein, 23 aa, Artificial Sequence
  source: /note="Description of Artificial Sequence: Synthetic peptide"
  MOD_RES (18)..(18): Diamino butanoic acid terminating in acrylamide or diamino butanoic acid terminating in bromoacetyl
KNSKLLSTSAKRIQKELXDITLD

SEQ ID NO: 335 - protein, 23 aa, Artificial Sequence
  source: /note="Description of Artificial Sequence: Synthetic peptide"
  MOD_RES (18)..(18): Diamino butanoic acid terminating in acrylamide or diamino butanoic acid terminating in bromoacetyl
KTAAKLSTSAKRIQKELXEITLD

SEQ ID NO: 336 - protein, 23 aa, Artificial Sequence
  source: /note="Description of Artificial Sequence: Synthetic peptide"
  MOD_RES (18)..(18): Diamino butanoic acid terminating in acrylamide or diamino butanoic acid terminating in bromoacetyl
KTTAKLSTSAKRIQKELXEITLD

SEQ ID NO: 337 - protein, 20 aa, Artificial Sequence
  source: /note="Description of Artificial Sequence: Synthetic peptide"
  MOD_RES (15)..(15): Diamino butanoic acid terminating in acrylamide or diamino butanoic acid terminating in bromoacetyl
MHGRAYLLLHRDFCXLKENN

SEQ ID NO: 338 - protein, 25 aa, Artificial Sequence
  source: /note="Description of Artificial Sequence: Synthetic peptide"
  MOD_RES (20)..(20): Diamino butanoic acid terminating in acrylamide or diamino butanoic acid terminating in bromoacetyl
METRYNLKSPAVKRLMKEAXELKDP

SEQ ID NO: 339 - protein, 27 aa, Artificial Sequence
  source: /note="Description of Artificial Sequence: Synthetic peptide"
  MOD_RES (22)..(22): Diamino butanoic acid terminating in acrylamide or diamino butanoic acid terminating in bromoacetyl
MSSTSSKRAPTTATQRLKQDYXRIKKD

SEQ ID NO: 340 - protein, 18 aa, Artificial Sequence
  source: /note="Description of Artificial Sequence: Synthetic peptide"
  MOD_RES (13)..(13): Diamino butanoic acid terminating in acrylamide or diamino butanoic acid terminating in bromoacetyl
MAGLPRRIIKETXRLLAE

SEQ ID NO: 341 - protein, 18 aa, Artificial Sequence
  source: /note="Description of Artificial Sequence: Synthetic peptide"
  MOD_RES (13)..(13): Diamino butanoic acid terminating in acrylamide or diamino butanoic acid terminating in bromoacetyl
MAELPHRIIKETXRLLAE

SEQ ID NO: 342 - protein, 17 aa, Artificial Sequence
  source: /note="Description of Artificial Sequence: Synthetic peptide"
  MOD_RES (12)..(12): Diamino butanoic acid terminating in acrylamide or diamino butanoic acid terminating in bromoacetyl
MQRASRLKRELXMLATE

SEQ ID NO: 343 - protein, 27 aa, Artificial Sequence
  source: /note="Description of Artificial Sequence: Synthetic peptide"
  MOD_RES (22)..(22): Diamino butanoic acid terminating in acrylamide or diamino butanoic acid terminating in bromoacetyl
MAATTGSGVKVPRNFRLLEELXEGQKG

SEQ ID NO: 344 - protein, 25 aa, Artificial Sequence
  source: /note="Description of Artificial Sequence: Synthetic peptide"
  MOD_RES (20)..(20): Diamino butanoic acid terminating in acrylamide or diamino butanoic acid terminating in bromoacetyl
MAVSTGVKVPRNFRLLEELXEGQKG

SEQ ID NO: 345 - protein, 26 aa, Artificial Sequence
  source: /note="Description of Artificial Sequence: Synthetic peptide"
  MOD_RES (21)..(21): Diamino butanoic acid terminating in acrylamide or diamino butanoic acid terminating in bromoacetyl
MNSNVENLPPHIIRLVYKEVXTLTAD

SEQ ID NO: 346 - protein, 19 aa, Artificial Sequence
  source: /note="Description of Artificial Sequence: Synthetic peptide"
  MOD_RES (14)..(14): Diamino butanoic acid terminating in acrylamide or diamino butanoic acid terminating in bromoacetyl
ARGPVGKRLQQELXTLMMS

SEQ ID NO: 347 - protein, 18 aa, Artificial Sequence
  source: /note="Description of Artificial Sequence: Synthetic peptide"
  MOD_RES (13)..(13): Diamino butanoic acid terminating in acrylamide or diamino butanoic acid terminating in bromoacetyl
MASMQKRLQKELXALQND

SEQ ID NO: 348 - protein, 18 aa, Artificial Sequence
  source: /note="Description of Artificial Sequence: Synthetic peptide"
  MOD_RES (13)..(13): Diamino butanoic acid terminating in acrylamide or diamino butanoic acid terminating in bromoacetyl
AKKFFSTVRKEMXLLATS

SEQ ID NO: 349 - protein, 23 aa, Artificial Sequence
  source: /note="Description of Artificial Sequence: Synthetic peptide"
  MOD_RES (18)..(18): Diamino butanoic acid terminating in acrylamide or diamino butanoic acid terminating in bromoacetyl
ANDANSAARARRLAQEAXTLSTS

SEQ ID NO: 350 - protein, 17 aa, Artificial Sequence
  source: /note="Description of Artificial Sequence: Synthetic peptide"
  MOD_RES (12)..(12): Diamino butanoic acid terminating in acrylamide or diamino butanoic acid terminating in bromoacetyl
MAASRRLMKELXEIRKC

SEQ ID NO: 351 - protein, 17 aa, Artificial Sequence
  source: /note="Description of Artificial Sequence: Synthetic peptide"
  MOD_RES (12)..(12): Diamino butanoic acid terminating in acrylamide or diamino butanoic acid terminating in bromoacetyl
MMASMRVVKELXDLQKK

SEQ ID NO: 352 - protein, 19 aa, Artificial Sequence
  source: /note="Description of Artificial Sequence: Synthetic peptide"
  MOD_RES (14)..(14): Diamino butanoic acid terminating in acrylamide or diamino butanoic acid terminating in bromoacetyl
GPFYLEYSLLAEFXLVVKQ

SEQ ID NO: 353 - protein, 23 aa, Artificial Sequence
  source: /note="Description of Artificial Sequence: Synthetic peptide"
  MOD_RES (18)..(18): Diamino butanoic acid terminating in acrylamide or diamino butanoic acid terminating in bromoacetyl
GAVSGSVQATDRLMKELXDIYRS

SEQ ID NO: 354 - protein, 23 aa, Artificial Sequence
  source: /note="Description of Artificial Sequence: Synthetic peptide"
  MOD_RES (18)..(18): Diamino butanoic acid terminating in acrylamide or diamino butanoic acid terminating in bromoacetyl
GAVSGSVQASDRLMKELXDIYRS

SEQ ID NO: 355 - protein, 21 aa, Artificial Sequence
  source: /note="Description of Artificial Sequence: Synthetic peptide"
  MOD_RES (16)..(16): Diamino butanoic acid terminating in acrylamide or diamino butanoic acid terminating in bromoacetyl
MSSPSPGKRRMDTDVXKLIES

SEQ ID NO: 356 - protein, 17 aa, Artificial Sequence
  source: /note="Description of Artificial Sequence: Synthetic peptide"
  MOD_RES (14)..(14): Diamino butanoic acid terminating in acrylamide or diamino butanoic acid terminating in bromoacetyl
MSTPARRRLMRDFXRLQ

SEQ ID NO: 357 - protein, 14 aa, Artificial Sequence
  source: /note="Description of Artificial Sequence: Synthetic peptide"
  MOD_RES (14)..(14): Diamino butanoic acid terminating in acrylamide or diamino butanoic acid terminating in bromoacetyl
MAGTALKRLMAEYX

SEQ ID NO: 358 - protein, 16 aa, Artificial Sequence
  source: /note="Description of Artificial Sequence: Synthetic peptide"
  MOD_RES (11)..(11): Diamino butanoic acid terminating in acrylamide or diamino butanoic acid terminating in bromoacetyl
MALKRINRELXDLGKD

SEQ ID NO: 359 - protein, 20 aa, Artificial Sequence
  source: /note="Description of Artificial Sequence: Synthetic peptide"
  MOD_RES (15)..(15): Diamino butanoic acid terminating in acrylamide or diamino butanoic acid terminating in bromoacetyl
MPSSASEQLLRKQLXEIQKN

SEQ ID NO: 360 - protein, 20 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (11)..(11): Non-natural electrophile containing amino acid or absent
  MOD_RES (13)..(13): Any non-natural amino acid which can be covalently joined "stapled together") using a ring-closing metathesis (RCM) reaction to form a cross-linked ring
XANIAXVQRIXRXFKEVLKS

SEQ ID NO: 361 - protein, 20 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (11)..(11): Non-natural electrophile containing amino acid or absent
  MOD_RES (13)..(13): Any non-natural amino acid which can be covalently joined "stapled together") using a ring-closing metathesis (RCM) reaction to form a cross-linked ring
XSTPAXRRRLXRXFKRLQED

SEQ ID NO: 362 - protein, 20 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (11)..(11): Non-natural electrophile containing amino acid or absent
  MOD_RES (13)..(13): Any non-natural amino acid which can be covalently joined "stapled together") using a ring-closing metathesis (RCM) reaction to form a cross-linked ring
XTELQXALLLXRXLAELNKN

SEQ ID NO: 363 - protein, 19 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (10)..(10): Non-natural electrophile containing amino acid or absent
  MOD_RES (12)..(12): Any non-natural amino acid which can be covalently joined "stapled together") using a ring-closing metathesis (RCM) reaction to form a cross-linked ring
XAGTXLKRLXAXYKQLTLN

SEQ ID NO: 364 - protein, 23 aa, Artificial Sequence
  source: /note="Description of Artificial Sequence: Synthetic peptide"
  MOD_RES (1)..(1): Norleucine
  MOD_RES (9)..(9): Any non-natural amino acid which can be covalently joined "stapled together") using a ring-closing metathesis (RCM) reaction to form a cross-linked ring
  MOD_RES (14)..(14): Non-natural electrophile containing amino acid or absent
  MOD_RES (16)..(16): Any non-natural amino acid which can be covalently joined "stapled together") using a ring-closing metathesis (RCM) reaction to form a cross-linked ring
XARPLVPSXQKALXLXLKGLQEE

SEQ ID NO: 365 - protein, 23 aa, Artificial Sequence
  source: /note="Description of Artificial Sequence: Synthetic peptide"
  MOD_RES (1)..(1): Norleucine
  MOD_RES (6)..(6): Norleucine
  MOD_RES (9)..(9): Any non-natural amino acid which can be covalently joined "stapled together") using a ring-closing metathesis (RCM) reaction to form a cross-linked ring
  MOD_RES (14)..(14): Non-natural electrophile containing amino acid or absent
  MOD_RES (16)..(16): Any non-natural amino acid which can be covalently joined "stapled together") using a ring-closing metathesis (RCM) reaction to form a cross-linked ring
XAQQQXTSXQKALXLXLKSLQEE

SEQ ID NO: 366 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (7)..(7): Non-natural electrophile containing amino acid or absent
  MOD_RES (9)..(9): Any non-natural amino acid which can be covalently joined "stapled together") using a ring-closing metathesis (RCM) reaction to form a cross-linked ring
XXLKRIXKXLSDLQRD

SEQ ID NO: 367 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (7)..(7): Non-natural electrophile containing amino acid or absent
  MOD_RES (9)..(9): Any non-natural amino acid which can be covalently joined "stapled together") using a ring-closing metathesis (RCM) reaction to form a cross-linked ring
XXLKRIXKXLNDLARD

SEQ ID NO: 368 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (7)..(7): Non-natural electrophile containing amino acid or absent
  MOD_RES (9)..(9): Any non-natural amino acid which can be covalently joined "stapled together") using a ring-closing metathesis (RCM) reaction to form a cross-linked ring
XXLKRIXKXLSDLARD

SEQ ID NO: 369 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (7)..(7): Non-natural electrophile containing amino acid or absent
  MOD_RES (9)..(9): Any non-natural amino acid which can be covalently joined "stapled together") using a ring-closing metathesis (RCM) reaction to form a cross-linked ring
XXLKRIXKXLTDLQRD

SEQ ID NO: 370 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (14)..(14): Non-natural electrophile containing amino acid or absent
  MOD_RES (16)..(16): Any non-natural amino acid which can be covalently joined "stapled together") using a ring-closing metathesis (RCM) reaction to form a cross-linked ring
KNSKLLSTXAKRIXKXLADITLD

SEQ ID NO: 371 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (14)..(14): Non-natural electrophile containing amino acid or absent
  MOD_RES (16)..(16): Any non-natural amino acid which can be covalently joined "stapled together") using a ring-closing metathesis (RCM) reaction to form a cross-linked ring
KTAAKLSTXAKRIXKXLAEITLD

SEQ ID NO: 372 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (14)..(14): Non-natural electrophile containing amino acid or absent
  MOD_RES (16)..(16): Any non-natural amino acid which can be covalently joined "stapled together") using a ring-closing metathesis (RCM) reaction to form a cross-linked ring
KTTAKLSTXAKRIXKXLAEITLD

SEQ ID NO: 373 - protein, 20 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (11)..(11): Non-natural electrophile containing amino acid or absent
  MOD_RES (13)..(13): Any non-natural amino acid which can be covalently joined "stapled together") using a ring-closing metathesis (RCM) reaction to form a cross-linked ring
XHGRAXLLLHXDXCDLKENN

SEQ ID NO: 374 - protein, 25 aa, Artificial Sequence
  source: /note="Description of Artificial Sequence: Synthetic peptide"
  MOD_RES (1)..(1): Norleucine
  MOD_RES (11)..(11): Any non-natural amino acid which can be covalently joined "stapled together") using a ring-closing metathesis (RCM) reaction to form a cross-linked ring
  MOD_RES (16)..(16): Non-natural electrophile containing amino acid or absent
  MOD_RES (18)..(18): Any non-natural amino acid which can be covalently joined "stapled together") using a ring-closing metathesis (RCM) reaction to form a cross-linked ring
XETRYNLKSPXVKRLXKXAAELKDP

SEQ ID NO: 375 - protein, 27 aa, Artificial Sequence
  source: /note="Description of Artificial Sequence: Synthetic peptide"
  MOD_RES (1)..(1): Norleucine
  MOD_RES (13)..(13): Any non-natural amino acid which can be covalently joined "stapled together") using a ring-closing metathesis (RCM) reaction to form a cross-linked ring
  MOD_RES (18)..(18): Non-natural electrophile containing amino acid or absent
  MOD_RES (20)..(20): Any non-natural amino acid which can be covalently joined "stapled together") using a ring-closing metathesis (RCM) reaction to form a cross-linked ring
XSSTSSKRAPTTXTQRLXQXYLRIKKD

SEQ ID NO: 376 - protein, 18 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (9)..(9): Non-natural electrophile containing amino acid or absent
  MOD_RES (11)..(11): Any non-natural amino acid which can be covalently joined "stapled together") using a ring-closing metathesis (RCM) reaction to form a cross-linked ring
XAGXPRRIXKXTQRLLAE

SEQ ID NO: 377 - protein, 18 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (9)..(9): Non-natural electrophile containing amino acid or absent
  MOD_RES (11)..(11): Any non-natural amino acid which can be covalently joined "stapled together") using a ring-closing metathesis (RCM) reaction to form a cross-linked ring
XAEXPHRIXKXTQRLLAE

SEQ ID NO: 378 - protein, 17 aa, Artificial Sequence
  source: /note="Description of Artificial Sequence: Synthetic peptide"
  MOD_RES (1)..(1): Norleucine
  MOD_RES (3)..(3): Any non-natural amino acid which can be covalently joined "stapled together") using a ring-closing metathesis (RCM) reaction to form a cross-linked ring
  MOD_RES (8)..(8): Non-natural electrophile containing amino acid or absent
  MOD_RES (10)..(10): Any non-natural amino acid which can be covalently joined "stapled together") using a ring-closing metathesis (RCM) reaction to form a cross-linked ring
  MOD_RES (13)..(13): Norleucine
XQXASRLXRXLHXLATE

SEQ ID NO: 379 - protein, 27 aa, Artificial Sequence
  source: /note="Description of Artificial Sequence: Synthetic peptide"
  MOD_RES (1)..(1): Norleucine
  MOD_RES (13)..(13): Any non-natural amino acid which can be covalently joined "stapled together") using a ring-closing metathesis (RCM) reaction to form a cross-linked ring
  MOD_RES (18)..(18): Non-natural electrophile containing amino acid or absent
  MOD_RES (20)..(20): Any non-natural amino acid which can be covalently joined "stapled together") using a ring-closing metathesis (RCM) reaction to form a cross-linked ring
XAATTGSGVKVPXNFRLXEXLEEGQKG

SEQ ID NO: 380 - protein, 25 aa, Artificial Sequence
  source: /note="Description of Artificial Sequence: Synthetic peptide"
  MOD_RES (1)..(1): Norleucine
  MOD_RES (11)..(11): Any non-natural amino acid which can be covalently joined "stapled together") using a ring-closing metathesis (RCM) reaction to form a cross-linked ring
  MOD_RES (16)..(16): Non-natural electrophile containing amino acid or absent
  MOD_RES (18)..(18): Any non-natural amino acid which can be covalently joined "stapled together") using a ring-closing metathesis (RCM) reaction to form a cross-linked ring
XAVSTGVKVPXNFRLXEXLEEGQKG

SEQ ID NO: 381 - protein, 26 aa, Artificial Sequence
  source: /note="Description of Artificial Sequence: Synthetic peptide"
  MOD_RES (1)..(1): Norleucine
  MOD_RES (12)..(12): Any non-natural amino acid which can be covalently joined "stapled together") using a ring-closing metathesis (RCM) reaction to form a cross-linked ring
  MOD_RES (17)..(17): Non-natural electrophile containing amino acid or absent
  MOD_RES (19)..(19): Any non-natural amino acid which can be covalently joined "stapled together") using a ring-closing metathesis (RCM) reaction to form a cross-linked ring
XNSNVENLPPHXIRLVXKXVTTLTAD

SEQ ID NO: 382 - protein, 19 aa, Artificial Sequence
  source: /note="Description of Artificial Sequence: Synthetic peptide"
  MOD_RES (5)..(5): Any non-natural amino acid which can be covalently joined "stapled together") using a ring-closing metathesis (RCM) reaction to form a cross-linked ring
  MOD_RES (10)..(10): Non-natural electrophile containing amino acid or absent
  MOD_RES (12)..(12): Any non-natural amino acid which can be covalently joined "stapled together") using a ring-closing metathesis (RCM) reaction to form a cross-linked ring
  MOD_RES (14)..(14): Norleucine
  MOD_RES (17)..(17): Norleucine
  MOD_RES (18)..(18): Norleucine
ARGPXGKRLXQXLXTLXXS

SEQ ID NO: 383 - protein, 18 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (9)..(9): Non-natural electrophile containing amino acid or absent
  MOD_RES (11)..(11): Any non-natural amino acid which can be covalently joined "stapled together") using a ring-closing metathesis (RCM) reaction to form a cross-linked ring
XASXQKRLXKXLLALQND

SEQ ID NO: 384 - protein, 18 aa, Artificial Sequence
  source: /note="Description of Artificial Sequence: Synthetic peptide"
  MOD_RES (4)..(4): Any non-natural amino acid which can be covalently joined "stapled together") using a ring-closing metathesis (RCM) reaction to form a cross-linked ring
  MOD_RES (9)..(9): Non-natural electrophile containing amino acid or absent
  MOD_RES (11)..(11): Any non-natural amino acid which can be covalently joined "stapled together") using a ring-closing metathesis (RCM) reaction to form a cross-linked ring
  MOD_RES (12)..(12): Norleucine
AKKXFSTVXKXXALLATS

SEQ ID NO: 385 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (14)..(14): Non-natural electrophile containing amino acid or absent
  MOD_RES (16)..(16): Any non-natural amino acid which can be covalently joined "stapled together") using a ring-closing metathesis (RCM) reaction to form a cross-linked ring
ANDANSAAXARRLXQXAVTLSTS

SEQ ID NO: 386 - protein, 17 aa, Artificial Sequence
  source: /note="Description of Artificial Sequence: Synthetic peptide"
  MOD_RES (1)..(1): Norleucine
  MOD_RES (3)..(3): Any non-natural amino acid which can be covalently joined "stapled together") using a ring-closing metathesis (RCM) reaction to form a cross-linked ring
  MOD_RES (8)..(8): Non-natural electrophile containing amino acid or absent
  MOD_RES (10)..(10): Any non-natural amino acid which can be covalently joined "stapled together") using a ring-closing metathesis (RCM) reaction to form a cross-linked ring
XAXSRRLXKXLEEIRKC

SEQ ID NO: 387 - protein, 17 aa, Artificial Sequence
  source: /note="Description of Artificial Sequence: Synthetic peptide"
  MOD_RES (1)..(1): Norleucine
  MOD_RES (2)..(2): Norleucine
  MOD_RES (3)..(3): Any non-natural amino acid which can be covalently joined "stapled together") using a ring-closing metathesis (RCM) reaction to form a cross-linked ring
  MOD_RES (5)..(5): Norleucine
  MOD_RES (8)..(8): Non-natural electrophile containing amino acid or absent
  MOD_RES (10)..(10): Any non-natural amino acid which can be covalently joined "stapled together") using a ring-closing metathesis (RCM) reaction to form a cross-linked ring
XXXSXRVXKXLEDLQKK

SEQ ID NO: 388 - protein, 19 aa, Artificial Sequence
  source: /note="Description of Artificial Sequence: Synthetic peptide"
  MOD_RES (5)..(5): Any non-natural amino acid which can be covalently joined "stapled together") using a ring-closing metathesis (RCM) reaction to form a cross-linked ring
  MOD_RES (10)..(10): Non-natural electrophile containing amino acid or absent
  MOD_RES (12)..(12): Any non-natural amino acid which can be covalently joined "stapled together") using a ring-closing metathesis (RCM) reaction to form a cross-linked ring
GPFYXEYSLXAXFTLVVKQ

SEQ ID NO: 389 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (14)..(14): Non-natural electrophile containing amino acid or absent
  MOD_RES (16)..(16): Any non-natural amino acid which can be covalently joined "stapled together") using a ring-closing metathesis (RCM) reaction to form a cross-linked ring
GAVSGSVQXTDRLXKXLRDIYRS

SEQ ID NO: 390 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (14)..(14): Non-natural electrophile containing amino acid or absent
  MOD_RES (16)..(16): Any non-natural amino acid which can be covalently joined "stapled together") using a ring-closing metathesis (RCM) reaction to form a cross-linked ring
GAVSGSVQXSDRLXKXLRDIYRS

SEQ ID NO: 391 - protein, 21 aa, Artificial Sequence
  source: /note="Description of Artificial Sequence: Synthetic peptide"
  MOD_RES (1)..(1): Norleucine
  MOD_RES (7)..(7): Any non-natural amino acid which can be covalently joined "stapled together") using a ring-closing metathesis (RCM) reaction to form a cross-linked ring
  MOD_RES (11)..(11): Norleucine
  MOD_RES (12)..(12): Non-natural electrophile containing amino acid or absent
  MOD_RES (14)..(14): Any non-natural amino acid which can be covalently joined "stapled together") using a ring-closing metathesis (RCM) reaction to form a cross-linked ring
XSSPSPXKRRXXTXVVKLIES

SEQ ID NO: 392 - protein, 17 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (10)..(10): Non-natural electrophile containing amino acid or absent
  MOD_RES (12)..(12): Any non-natural amino acid which can be covalently joined "stapled together") using a ring-closing metathesis (RCM) reaction to form a cross-linked ring
XSTPXRRRLXRXFKRLQ

SEQ ID NO: 393 - protein, 14 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (10)..(10): Non-natural electrophile containing amino acid or absent
  MOD_RES (12)..(12): Any non-natural amino acid which can be covalently joined "stapled together") using a ring-closing metathesis (RCM) reaction to form a cross-linked ring
XAGTXLKRLXAXYK

SEQ ID NO: 394 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (7)..(7): Non-natural electrophile containing amino acid or absent
  MOD_RES (9)..(9): Any non-natural amino acid which can be covalently joined "stapled together") using a ring-closing metathesis (RCM) reaction to form a cross-linked ring
XXLKRIXRXLADLGKD

SEQ ID NO: 395 - protein, 20 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (11)..(11): Non-natural electrophile containing amino acid or absent
  MOD_RES (13)..(13): Any non-natural amino acid which can be covalently joined "stapled together") using a ring-closing metathesis (RCM) reaction to form a cross-linked ring
XPSSAXEQLLXKXLKEIQKN

SEQ ID NO: 396 - protein, 19 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (11)..(11): Non-natural electrophile containing amino acid or absent
  MOD_RES (12)..(12): Any non-natural amino acid which can be covalently joined "stapled together") using a ring-closing metathesis (RCM) reaction to form a cross-linked ring
XANIXVQRIKXXFKEVLKS

SEQ ID NO: 397 - protein, 19 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (10)..(10): Norleucine
  MOD_RES (11)..(11): Non-natural electrophile containing amino acid or absent
  MOD_RES (12)..(12): Any non-natural amino acid which can be covalently joined "stapled together") using a ring-closing metathesis (RCM) reaction to form a cross-linked ring
XSTPXRRRLXXXFKRLQED

SEQ ID NO: 398 - protein, 20 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (12)..(12): Non-natural electrophile containing amino acid or absent
  MOD_RES (13)..(13): Any non-natural amino acid which can be covalently joined "stapled together") using a ring-closing metathesis (RCM) reaction to form a cross-linked ring
XTELQXALLLRXXLAELNKN

SEQ ID NO: 399 - protein, 19 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (10)..(10): Norleucine
  MOD_RES (11)..(11): Non-natural electrophile containing amino acid or absent
  MOD_RES (12)..(12): Any non-natural amino acid which can be covalently joined "stapled together") using a ring-closing metathesis (RCM) reaction to form a cross-linked ring
XAGTXLKRLXXXYKQLTLN

SEQ ID NO: 400 - protein, 23 aa, Artificial Sequence
  source: /note="Description of Artificial Sequence: Synthetic peptide"
  MOD_RES (1)..(1): Norleucine
  MOD_RES (9)..(9): Any non-natural amino acid which can be covalently joined "stapled together") using a ring-closing metathesis (RCM) reaction to form a cross-linked ring
  MOD_RES (15)..(15): Non-natural electrophile containing amino acid or absent
  MOD_RES (16)..(16): Any non-natural amino acid which can be covalently joined "stapled together") using a ring-closing metathesis (RCM) reaction to form a cross-linked ring
XARPLVPSXQKALLXXLKGLQEE

SEQ ID NO: 401 - protein, 23 aa, Artificial Sequence
  source: /note="Description of Artificial Sequence: Synthetic peptide"
  MOD_RES (1)..(1): Norleucine
  MOD_RES (6)..(6): Norleucine
  MOD_RES (9)..(9): Any non-natural amino acid which can be covalently joined "stapled together") using a ring-closing metathesis (RCM) reaction to form a cross-linked ring
  MOD_RES (14)..(14): Norleucine
  MOD_RES (15)..(15): Non-natural electrophile containing amino acid or absent
  MOD_RES (16)..(16): Any non-natural amino acid which can be covalently joined "stapled together") using a ring-closing metathesis (RCM) reaction to form a cross-linked ring
XAQQQXTSXQKALXXXLKSLQEE

SEQ ID NO: 402 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (8)..(8): Non-natural electrophile containing amino acid or absent
  MOD_RES (9)..(9): Any non-natural amino acid which can be covalently joined "stapled together") using a ring-closing metathesis (RCM) reaction to form a cross-linked ring
XXLKRIQXXLSDLQRD

SEQ ID NO: 403 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (8)..(8): Non-natural electrophile containing amino acid or absent
  MOD_RES (9)..(9): Any non-natural amino acid which can be covalently joined "stapled together") using a ring-closing metathesis (RCM) reaction to form a cross-linked ring
XXLKRIHXXLNDLARD

SEQ ID NO: 404 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (8)..(8): Non-natural electrophile containing amino acid or absent
  MOD_RES (9)..(9): Any non-natural amino acid which can be covalently joined "stapled together") using a ring-closing metathesis (RCM) reaction to form a cross-linked ring
XXLKRINXXLSDLARD

SEQ ID NO: 405 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (8)..(8): Non-natural electrophile containing amino acid or absent
  MOD_RES (9)..(9): Any non-natural amino acid which can be covalently joined "stapled together") using a ring-closing metathesis (RCM) reaction to form a cross-linked ring
XXLKRIQXXLTDLQRD

SEQ ID NO: 406 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (15)..(15): Non-natural electrophile containing amino acid or absent
  MOD_RES (16)..(16): Any non-natural amino acid which can be covalently joined "stapled together") using a ring-closing metathesis (RCM) reaction to form a cross-linked ring
KNSKLLSTXAKRIQXXLADITLD

SEQ ID NO: 407 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (15)..(15): Non-natural electrophile containing amino acid or absent
  MOD_RES (16)..(16): Any non-natural amino acid which can be covalently joined "stapled together") using a ring-closing metathesis (RCM) reaction to form a cross-linked ring
KTAAKLSTXAKRIQXXLAEITLD

SEQ ID NO: 408 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (15)..(15): Non-natural electrophile containing amino acid or absent
  MOD_RES (16)..(16): Any non-natural amino acid which can be covalently joined "stapled together") using a ring-closing metathesis (RCM) reaction to form a cross-linked ring
KTTAKLSTXAKRIQXXLAEITLD

SEQ ID NO: 409 - protein, 20 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (12)..(12): Non-natural electrophile containing amino acid or absent
  MOD_RES (13)..(13): Any non-natural amino acid which can be covalently joined "stapled together") using a ring-closing metathesis (RCM) reaction to form a cross-linked ring
XHGRAXLLLHRXXCDLKENN

SEQ ID NO: 410 - protein, 25 aa, Artificial Sequence
  source: /note="Description of Artificial Sequence: Synthetic peptide"
  MOD_RES (1)..(1): Norleucine
  MOD_RES (11)..(11): Any non-natural amino acid which can be covalently joined "stapled together") using a ring-closing metathesis (RCM) reaction to form a cross-linked ring
  MOD_RES (16)..(16): Norleucine
  MOD_RES (17)..(17): Non-natural electrophile containing amino acid or absent
  MOD_RES (18)..(18): Any non-natural amino acid which can be covalently joined "stapled together") using a ring-closing metathesis (RCM) reaction to form a cross-linked ring
XETRYNLKSPXVKRLXXXAAELKDP

SEQ ID NO: 411 - protein, 27 aa, Artificial Sequence
  source: /note="Description of Artificial Sequence: Synthetic peptide"
  MOD_RES (1)..(1): Norleucine
  MOD_RES (13)..(13): Any non-natural amino acid which can be covalently joined "stapled together") using a ring-closing metathesis (RCM) reaction to form a cross-linked ring
  MOD_RES (19)..(19): Non-natural electrophile containing amino acid or absent
  MOD_RES (20)..(20): Any non-natural amino acid which can be covalently joined "stapled together") using a ring-closing metathesis (RCM) reaction to form a cross-linked ring
XSSTSSKRAPTTXTQRLKXXYLRIKKD

SEQ ID NO: 412 - protein, 18 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (10)..(10): Non-natural electrophile containing amino acid or absent
  MOD_RES (11)..(11): Any non-natural amino acid which can be covalently joined "stapled together") using a ring-closing metathesis (RCM) reaction to form a cross-linked ring
XAGXPRRIIXXTQRLLAE

SEQ ID NO: 413 - protein, 18 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (10)..(10): Non-natural electrophile containing amino acid or absent
  MOD_RES (11)..(11): Any non-natural amino acid which can be covalently joined "stapled together") using a ring-closing metathesis (RCM) reaction to form a cross-linked ring
XAEXPHRIIXXTQRLLAE

SEQ ID NO: 414 - protein, 17 aa, Artificial Sequence
  source: /note="Description of Artificial Sequence: Synthetic peptide"
  MOD_RES (1)..(1): Norleucine
  MOD_RES (3)..(3): Any non-natural amino acid which can be covalently joined "stapled together") using a ring-closing metathesis (RCM) reaction to form a cross-linked ring
  MOD_RES (9)..(9): Non-natural electrophile containing amino acid or absent
  MOD_RES (10)..(10): Any non-natural amino acid which can be covalently joined "stapled together") using a ring-closing metathesis (RCM) reaction to form a cross-linked ring
  MOD_RES (13)..(13): Norleucine
XQXASRLKXXLHXLATE

SEQ ID NO: 415 - protein, 27 aa, Artificial Sequence
  source: /note="Description of Artificial Sequence: Synthetic peptide"
  MOD_RES (1)..(1): Norleucine
  MOD_RES (13)..(13): Any non-natural amino acid which can be covalently joined "stapled together") using a ring-closing metathesis (RCM) reaction to form a cross-linked ring
  MOD_RES (19)..(19): Non-natural electrophile containing amino acid or absent
  MOD_RES (20)..(20): Any non-natural amino acid which can be covalently joined "stapled together") using a ring-closing metathesis (RCM) reaction to form a cross-linked ring
XAATTGSGVKVPXNFRLLXXLEEGQKG

SEQ ID NO: 416 - protein, 25 aa, Artificial Sequence
  source: /note="Description of Artificial Sequence: Synthetic peptide"
  MOD_RES (1)..(1): Norleucine
  MOD_RES (11)..(11): Any non-natural amino acid which can be covalently joined "stapled together") using a ring-closing metathesis (RCM) reaction to form a cross-linked ring
  MOD_RES (17)..(17): Non-natural electrophile containing amino acid or absent
  MOD_RES (18)..(18): Any non-natural amino acid which can be covalently joined "stapled together") using a ring-closing metathesis (RCM) reaction to form a cross-linked ring
XAVSTGVKVPXNFRLLXXLEEGQKG

SEQ ID NO: 417 - protein, 26 aa, Artificial Sequence
  source: /note="Description of Artificial Sequence: Synthetic peptide"
  MOD_RES (1)..(1): Norleucine
  MOD_RES (12)..(12): Any non-natural amino acid which can be covalently joined "stapled together") using a ring-closing metathesis (RCM) reaction to form a cross-linked ring
  MOD_RES (18)..(18): Non-natural electrophile containing amino acid or absent
  MOD_RES (19)..(19): Any non-natural amino acid which can be covalently joined "stapled together") using a ring-closing metathesis (RCM) reaction to form a cross-linked ring
XNSNVENLPPHXIRLVYXXVTTLTAD

SEQ ID NO: 418 - protein, 19 aa, Artificial Sequence
  source: /note="Description of Artificial Sequence: Synthetic peptide"
  MOD_RES (5)..(5): Any non-natural amino acid which can be covalently joined "stapled together") using a ring-closing metathesis (RCM) reaction to form a cross-linked ring
  MOD_RES (11)..(11): Non-natural electrophile containing amino acid or absent
  MOD_RES (12)..(12): Any non-natural amino acid which can be covalently joined "stapled together") using a ring-closing metathesis (RCM) reaction to form a cross-linked ring
  MOD_RES (14)..(14): Norleucine
  MOD_RES (17)..(17): Norleucine
  MOD_RES (18)..(18): Norleucine
ARGPXGKRLQXXLXTLXXS

SEQ ID NO: 419 - protein, 18 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (10)..(10): Non-natural electrophile containing amino acid or absent
  MOD_RES (11)..(11): Any non-natural amino acid which can be covalently joined "stapled together") using a ring-closing metathesis (RCM) reaction to form a cross-linked ring
XASXQKRLQXXLLALQND

SEQ ID NO: 420 - protein, 18 aa, Artificial Sequence
  source: /note="Description of Artificial Sequence: Synthetic peptide"
  MOD_RES (4)..(4): Any non-natural amino acid which can be covalently joined "stapled together") using a ring-closing metathesis (RCM) reaction to form a cross-linked ring
  MOD_RES (10)..(10): Non-natural electrophile containing amino acid or absent
  MOD_RES (11)..(11): Any non-natural amino acid which can be covalently joined "stapled together") using a ring-closing metathesis (RCM) reaction to form a cross-linked ring
  MOD_RES (12)..(12): Norleucine
AKKXFSTVRXXXALLATS

SEQ ID NO: 421 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (15)..(15): Non-natural electrophile containing amino acid or absent
  MOD_RES (16)..(16): Any non-natural amino acid which can be covalently joined "stapled together") using a ring-closing metathesis (RCM) reaction to form a cross-linked ring
ANDANSAAXARRLAXXAVTLSTS

SEQ ID NO: 422 - protein, 17 aa, Artificial Sequence
  source: /note="Description of Artificial Sequence: Synthetic peptide"
  MOD_RES (1)..(1): Norleucine
  MOD_RES (3)..(3): Any non-natural amino acid which can be covalently joined "stapled together") using a ring-closing metathesis (RCM) reaction to form a cross-linked ring
  MOD_RES (8)..(8): Norleucine
  MOD_RES (9)..(9): Non-natural electrophile containing amino acid or absent
  MOD_RES (10)..(10): Any non-natural amino acid which can be covalently joined "stapled together") using a ring-closing metathesis (RCM) reaction to form a cross-linked ring
XAXSRRLXXXLEEIRKC

SEQ ID NO: 423 - protein, 17 aa, Artificial Sequence
  source: /note="Description of Artificial Sequence: Synthetic peptide"
  MOD_RES (1)..(1): Norleucine
  MOD_RES (2)..(2): Norleucine
  MOD_RES (3)..(3): Any non-natural amino acid which can be covalently joined "stapled together") using a ring-closing metathesis (RCM) reaction to form a cross-linked ring
  MOD_RES (5)..(5): Norleucine
  MOD_RES (9)..(9): Non-natural electrophile containing amino acid or absent
  MOD_RES (10)..(10): Any non-natural amino acid which can be covalently joined "stapled together") using a ring-closing metathesis (RCM) reaction to form a cross-linked ring
XXXSXRVVXXLEDLQKK

SEQ ID NO: 424 - protein, 19 aa, Artificial Sequence
  source: /note="Description of Artificial Sequence: Synthetic peptide"
  MOD_RES (5)..(5): Any non-natural amino acid which can be covalently joined "stapled together") using a ring-closing metathesis (RCM) reaction to form a cross-linked ring
  MOD_RES (11)..(11): Non-natural electrophile containing amino acid or absent
  MOD_RES (12)..(12): Any non-natural amino acid which can be covalently joined "stapled together") using a ring-closing metathesis (RCM) reaction to form a cross-linked ring
GPFYXEYSLLXXFTLVVKQ

SEQ ID NO: 425 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (14)..(14): Norleucine
  MOD_RES (15)..(15): Non-natural electrophile containing amino acid or absent
  MOD_RES (16)..(16): Any non-natural amino acid which can be covalently joined "stapled together") using a ring-closing metathesis (RCM) reaction to form a cross-linked ring
GAVSGSVQXTDRLXXXLRDIYRS

SEQ ID NO: 426 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (14)..(14): Norleucine
  MOD_RES (15)..(15): Non-natural electrophile containing amino acid or absent
  MOD_RES (16)..(16): Any non-natural amino acid which can be covalently joined "stapled together") using a ring-closing metathesis (RCM) reaction to form a cross-linked ring
GAVSGSVQXSDRLXXXLRDIYRS

SEQ ID NO: 427 - protein, 21 aa, Artificial Sequence
  source: /note="Description of Artificial Sequence: Synthetic peptide"
  MOD_RES (1)..(1): Norleucine
  MOD_RES (7)..(7): Any non-natural amino acid which can be covalently joined "stapled together") using a ring-closing metathesis (RCM) reaction to form a cross-linked ring
  MOD_RES (11)..(11): Norleucine
  MOD_RES (13)..(13): Non-natural electrophile containing amino acid or absent
  MOD_RES (14)..(14): Any non-natural amino acid which can be covalently joined "stapled together") using a ring-closing metathesis (RCM) reaction to form a cross-linked ring
XSSPSPXKRRXDXXVVKLIES

SEQ ID NO: 428 - protein, 17 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (10)..(10): Norleucine
  MOD_RES (11)..(11): Non-natural electrophile containing amino acid or absent
  MOD_RES (12)..(12): Any non-natural amino acid which can be covalently joined "stapled together") using a ring-closing metathesis (RCM) reaction to form a cross-linked ring
XSTPXRRRLXXXFKRLQ

SEQ ID NO: 429 - protein, 14 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (10)..(10): Norleucine
  MOD_RES (11)..(11): Non-natural electrophile containing amino acid or absent
  MOD_RES (12)..(12): Any non-natural amino acid which can be covalently joined "stapled together") using a ring-closing metathesis (RCM) reaction to form a cross-linked ring
XAGTXLKRLXXXYK

SEQ ID NO: 430 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (8)..(8): Non-natural electrophile containing amino acid or absent
  MOD_RES (9)..(9): Any non-natural amino acid which can be covalently joined "stapled together") using a ring-closing metathesis (RCM) reaction to form a cross-linked ring
XXLKRINXXLADLGKD

SEQ ID NO: 431 - protein, 20 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (12)..(12): Non-natural electrophile containing amino acid or absent
  MOD_RES (13)..(13): Any non-natural amino acid which can be covalently joined "stapled together") using a ring-closing metathesis (RCM) reaction to form a cross-linked ring
XPSSAXEQLLRXXLKEIQKN

SEQ ID NO: 432 - protein, 19 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (12)..(12): Any non-natural amino acid which can be covalently joined "stapled together") using a ring-closing metathesis (RCM) reaction to form a cross-linked ring
  MOD_RES (14)..(14): Non-natural electrophile containing amino acid or absent
XANIXVQRIKRXFXEVLKS

SEQ ID NO: 433 - protein, 19 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (10)..(10): Norleucine
  MOD_RES (12)..(12): Any non-natural amino acid which can be covalently joined "stapled together") using a ring-closing metathesis (RCM) reaction to form a cross-linked ring
  MOD_RES (14)..(14): Non-natural electrophile containing amino acid or absent
XSTPXRRRLXRXFXRLQED

SEQ ID NO: 434 - protein, 20 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (13)..(13): Any non-natural amino acid which can be covalently joined "stapled together") using a ring-closing metathesis (RCM) reaction to form a cross-linked ring
  MOD_RES (15)..(15): Non-natural electrophile containing amino acid or absent
XTELQXALLLRRXLXELNKN

SEQ ID NO: 435 - protein, 19 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (10)..(10): Norleucine
  MOD_RES (12)..(12): Any non-natural amino acid which can be covalently joined "stapled together") using a ring-closing metathesis (RCM) reaction to form a cross-linked ring
  MOD_RES (14)..(14): Non-natural electrophile containing amino acid or absent
XAGTXLKRLXAXYXQLTLN

SEQ ID NO: 436 - protein, 23 aa, Artificial Sequence
  source: /note="Description of Artificial Sequence: Synthetic peptide"
  MOD_RES (1)..(1): Norleucine
  MOD_RES (9)..(9): Any non-natural amino acid which can be covalently joined "stapled together") using a ring-closing metathesis (RCM) reaction to form a cross-linked ring
  MOD_RES (16)..(16): Any non-natural amino acid which can be covalently joined "stapled together") using a ring-closing metathesis (RCM) reaction to form a cross-linked ring
  MOD_RES (18)..(18): Non-natural electrophile containing amino acid or absent
XARPLVPSXQKALLLXLXGLQEE

SEQ ID NO: 437 - protein, 23 aa, Artificial Sequence
  source: /note="Description of Artificial Sequence: Synthetic peptide"
  MOD_RES (1)..(1): Norleucine
  MOD_RES (6)..(6): Norleucine
  MOD_RES (9)..(9): Any non-natural amino acid which can be covalently joined "stapled together") using a ring-closing metathesis (RCM) reaction to form a cross-linked ring
  MOD_RES (14)..(14): Norleucine
  MOD_RES (16)..(16): Any non-natural amino acid which can be covalently joined "stapled together") using a ring-closing metathesis (RCM) reaction to form a cross-linked ring
  MOD_RES (18)..(18): Non-natural electrophile containing amino acid or absent
XAQQQXTSXQKALXLXLXSLQEE

SEQ ID NO: 438 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (9)..(9): Any non-natural amino acid which can be covalently joined "stapled together") using a ring-closing metathesis (RCM) reaction to form a cross-linked ring
  MOD_RES (11)..(11): Non-natural electrophile containing amino acid or absent
XXLKRIQKXLXDLQRD

SEQ ID NO: 439 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (9)..(9): Any non-natural amino acid which can be covalently joined "stapled together") using a ring-closing metathesis (RCM) reaction to form a cross-linked ring
  MOD_RES (11)..(11): Non-natural electrophile containing amino acid or absent
XXLKRIHKXLXDLARD

SEQ ID NO: 440 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (9)..(9): Any non-natural amino acid which can be covalently joined "stapled together") using a ring-closing metathesis (RCM) reaction to form a cross-linked ring
  MOD_RES (11)..(11): Non-natural electrophile containing amino acid or absent
XXLKRINKXLXDLARD

SEQ ID NO: 441 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (9)..(9): Any non-natural amino acid which can be covalently joined "stapled together") using a ring-closing metathesis (RCM) reaction to form a cross-linked ring
  MOD_RES (11)..(11): Non-natural electrophile containing amino acid or absent
XXLKRIQKXLXDLQRD

SEQ ID NO: 442 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (16)..(16): Any non-natural amino acid which can be covalently joined "stapled together") using a ring-closing metathesis (RCM) reaction to form a cross-linked ring
  MOD_RES (18)..(18): Non-natural electrophile containing amino acid or absent
KNSKLLSTXAKRIQKXLXDITLD

SEQ ID NO: 443 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (16)..(16): Any non-natural amino acid which can be covalently joined "stapled together") using a ring-closing metathesis (RCM) reaction to form a cross-linked ring
  MOD_RES (18)..(18): Non-natural electrophile containing amino acid or absent
KTAAKLSTXAKRIQKXLXEITLD

SEQ ID NO: 444 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (16)..(16): Any non-natural amino acid which can be covalently joined "stapled together") using a ring-closing metathesis (RCM) reaction to form a cross-linked ring
  MOD_RES (18)..(18): Non-natural electrophile containing amino acid or absent
KTTAKLSTXAKRIQKXLXEITLD

SEQ ID NO: 445 - protein, 20 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (13)..(13): Any non-natural amino acid which can be covalently joined "stapled together") using a ring-closing metathesis (RCM) reaction to form a cross-linked ring
  MOD_RES (15)..(15): Non-natural electrophile containing amino acid or absent
XHGRAXLLLHRDXCXLKENN

SEQ ID NO: 446 - protein, 25 aa, Artificial Sequence
  source: /note="Description of Artificial Sequence: Synthetic peptide"
  MOD_RES (1)..(1): Norleucine
  MOD_RES (11)..(11): Any non-natural amino acid which can be covalently joined "stapled together") using a ring-closing metathesis (RCM) reaction to form a cross-linked ring
  MOD_RES (16)..(16): Norleucine
  MOD_RES (18)..(18): Any non-natural amino acid which can be covalently joined "stapled together") using a ring-closing metathesis (RCM) reaction to form a cross-linked ring
  MOD_RES (20)..(20): Non-natural electrophile containing amino acid or absent
XETRYNLKSPXVKRLXKXAXELKDP

SEQ ID NO: 447 - protein, 27 aa, Artificial Sequence
  source: /note="Description of Artificial Sequence: Synthetic peptide"
  MOD_RES (1)..(1): Norleucine
  MOD_RES (13)..(13): Any non-natural amino acid which can be covalently joined "stapled together") using a ring-closing metathesis (RCM) reaction to form a cross-linked ring
  MOD_RES (20)..(20): Any non-natural amino acid which can be covalently joined "stapled together") using a ring-closing metathesis (RCM) reaction to form a cross-linked ring
  MOD_RES (22)..(22): Non-natural electrophile containing amino acid or absent
XSSTSSKRAPTTXTQRLKQXYXRIKKD

SEQ ID NO: 448 - protein, 18 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (11)..(11): Any non-natural amino acid which can be covalently joined "stapled together") using a ring-closing metathesis (RCM) reaction to form a cross-linked ring
  MOD_RES (13)..(13): Non-natural electrophile containing amino acid or absent
XAGXPRRIIKXTXRLLAE

SEQ ID NO: 449 - protein, 18 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (11)..(11): Any non-natural amino acid which can be covalently joined "stapled together") using a ring-closing metathesis (RCM) reaction to form a cross-linked ring
  MOD_RES (13)..(13): Non-natural electrophile containing amino acid or absent
XAEXPHRIIKXTXRLLAE

SEQ ID NO: 450 - protein, 17 aa, Artificial Sequence
  source: /note="Description of Artificial Sequence: Synthetic peptide"
  MOD_RES (1)..(1): Norleucine
  MOD_RES (3)..(3): Any non-natural amino acid which can be covalently joined "stapled together") using a ring-closing metathesis (RCM) reaction to form a cross-linked ring
  MOD_RES (10)..(10): Any non-natural amino acid which can be covalently joined "stapled together") using a ring-closing metathesis (RCM) reaction to form a cross-linked ring
  MOD_RES (12)..(12): Non-natural electrophile containing amino acid or absent
  MOD_RES (13)..(13): Norleucine
XQXASRLKRXLXXLATE

SEQ ID NO: 451 - protein, 27 aa, Artificial Sequence
  source: /note="Description of Artificial Sequence: Synthetic peptide"
  MOD_RES (1)..(1): Norleucine
  MOD_RES (13)..(13): Any non-natural amino acid which can be covalently joined "stapled together") using a ring-closing metathesis (RCM) reaction to form a cross-linked ring
  MOD_RES (20)..(20): Any non-natural amino acid which can be covalently joined "stapled together") using a ring-closing metathesis (RCM) reaction to form a cross-linked ring
  MOD_RES (22)..(22): Non-natural electrophile containing amino acid or absent
XAATTGSGVKVPXNFRLLEXLXEGQKG

SEQ ID NO: 452 - protein, 25 aa, Artificial Sequence
  source: /note="Description of Artificial Sequence: Synthetic peptide"
  MOD_RES (1)..(1): Norleucine
  MOD_RES (11)..(11): Any non-natural amino acid which can be covalently joined "stapled together") using a ring-closing metathesis (RCM) reaction to form a cross-linked ring
  MOD_RES (18)..(18): Any non-natural amino acid which can be covalently joined "stapled together") using a ring-closing metathesis (RCM) reaction to form a cross-linked ring
  MOD_RES (20)..(20): Non-natural electrophile containing amino acid or absent
XAVSTGVKVPXNFRLLEXLXEGQKG

SEQ ID NO: 453 - protein, 26 aa, Artificial Sequence
  source: /note="Description of Artificial Sequence: Synthetic peptide"
  MOD_RES (1)..(1): Norleucine
  MOD_RES (12)..(12): Any non-natural amino acid which can be covalently joined "stapled together") using a ring-closing metathesis (RCM) reaction to form a cross-linked ring
  MOD_RES (19)..(19): Any non-natural amino acid which can be covalently joined "stapled together") using a ring-closing metathesis (RCM) reaction to form a cross-linked ring
  MOD_RES (21)..(21): Non-natural electrophile containing amino acid or absent
XNSNVENLPPHXIRLVYKXVXTLTAD

SEQ ID NO: 454 - protein, 19 aa, Artificial Sequence
  source: /note="Description of Artificial Sequence: Synthetic peptide"
  MOD_RES (5)..(5): Any non-natural amino acid which can be covalently joined "stapled together") using a ring-closing metathesis (RCM) reaction to form a cross-linked ring
  MOD_RES (12)..(12): Any non-natural amino acid which can be covalently joined "stapled together") using a ring-closing metathesis (RCM) reaction to form a cross-linked ring
  MOD_RES (14)..(14): Non-natural electrophile containing amino acid or absent
  MOD_RES (17)..(17): Norleucine
  MOD_RES (18)..(18): Norleucine
ARGPXGKRLQQXLXTLXXS

SEQ ID NO: 455 - protein, 18 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (11)..(11): Any non-natural amino acid which can be covalently joined "stapled together") using a ring-closing metathesis (RCM) reaction to form a cross-linked ring
  MOD_RES (13)..(13): Non-natural electrophile containing amino acid or absent
XASXQKRLQKXLXALQND

SEQ ID NO: 456 - protein, 18 aa, Artificial Sequence
  source: /note="Description of Artificial Sequence: Synthetic peptide"
  MOD_RES (4)..(4): Any non-natural amino acid which can be covalently joined "stapled together") using a ring-closing metathesis (RCM) reaction to form a cross-linked ring
  MOD_RES (11)..(11): Any non-natural amino acid which can be covalently joined "stapled together") using a ring-closing metathesis (RCM) reaction to form a cross-linked ring
  MOD_RES (12)..(12): Norleucine
  MOD_RES (13)..(13): Non-natural electrophile containing amino acid or absent
AKKXFSTVRKXXXLLATS

SEQ ID NO: 457 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (16)..(16): Any non-natural amino acid which can be covalently joined "stapled together") using a ring-closing metathesis (RCM) reaction to form a cross-linked ring
  MOD_RES (18)..(18): Non-natural electrophile containing amino acid or absent
ANDANSAAXARRLAQXAXTLSTS

SEQ ID NO: 458 - protein, 17 aa, Artificial Sequence
  source: /note="Description of Artificial Sequence: Synthetic peptide"
  MOD_RES (1)..(1): Norleucine
  MOD_RES (3)..(3): Any non-natural amino acid which can be covalently joined "stapled together") using a ring-closing metathesis (RCM) reaction to form a cross-linked ring
  MOD_RES (8)..(8): Norleucine
  MOD_RES (10)..(10): Any non-natural amino acid which can be covalently joined "stapled together") using a ring-closing metathesis (RCM) reaction to form a cross-linked ring
  MOD_RES (12)..(12): Non-natural electrophile containing amino acid or absent
XAXSRRLXKXLXEIRKC

SEQ ID NO: 459 - protein, 17 aa, Artificial Sequence
  source: /note="Description of Artificial Sequence: Synthetic peptide"
  MOD_RES (1)..(1): Norleucine
  MOD_RES (2)..(2): Norleucine
  MOD_RES (3)..(3): Any non-natural amino acid which can be covalently joined "stapled together") using a ring-closing metathesis (RCM) reaction to form a cross-linked ring
  MOD_RES (5)..(5): Norleucine
  MOD_RES (10)..(10): Any non-natural amino acid which can be covalently joined "stapled together") using a ring-closing metathesis (RCM) reaction to form a cross-linked ring
  MOD_RES (12)..(12): Non-natural electrophile containing amino acid or absent
XXXSXRVVKXLXDLQKK

SEQ ID NO: 460 - protein, 19 aa, Artificial Sequence
  source: /note="Description of Artificial Sequence: Synthetic peptide"
  MOD_RES (5)..(5): Any non-natural amino acid which can be covalently joined "stapled together") using a ring-closing metathesis (RCM) reaction to form a cross-linked ring
  MOD_RES (12)..(12): Any non-natural amino acid which can be covalently joined "stapled together") using a ring-closing metathesis (RCM) reaction to form a cross-linked ring
  MOD_RES (14)..(14): Non-natural electrophile containing amino acid or absent
GPFYXEYSLLAXFXLVVKQ

SEQ ID NO: 461 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (14)..(14): Norleucine
  MOD_RES (16)..(16): Any non-natural amino acid which can be covalently joined "stapled together") using a ring-closing metathesis (RCM) reaction to form a cross-linked ring
  MOD_RES (18)..(18): Non-natural electrophile containing amino acid or absent
GAVSGSVQXTDRLXKXLXDIYRS

SEQ ID NO: 462 - protein, 23 aa, Artificial Sequence
  source: /note="Description of Artificial Sequence: Synthetic peptide"
  MOD_RES (9)..(9): Any non-natural amino acid which can be covalently joined "stapled together") using a ring-closing metathesis (RCM) reaction to form a cross-linked ring
  MOD_RES (14)..(14): Norleucine
  MOD_RES (16)..(16): Any non-natural amino acid which can be covalently joined "stapled together") using a ring-closing metathesis (RCM) reaction to form a cross-linked ring
  MOD_RES (18)..(18): Non-natural electrophile containing amino acid or absent
GAVSGSVQXSDRLXKXLXDIYRS

SEQ ID NO: 463 - protein, 21 aa, Artificial Sequence
  source: /note="Description of Artificial Sequence: Synthetic peptide"
  MOD_RES (1)..(1): Norleucine
  MOD_RES (7)..(7): Any non-natural amino acid which can be covalently joined "stapled together") using a ring-closing metathesis (RCM) reaction to form a cross-linked ring
  MOD_RES (11)..(11): Norleucine
  MOD_RES (14)..(14): Any non-natural amino acid which can be covalently joined "stapled together") using a ring-closing metathesis (RCM) reaction to form a cross-linked ring
  MOD_RES (16)..(16): Non-natural electrophile containing amino acid or absent
XSSPSPXKRRXDTXVXKLIES

SEQ ID NO: 464 - protein, 17 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (10)..(10): Norleucine
  MOD_RES (12)..(12): Any non-natural amino acid which can be covalently joined "stapled together") using a ring-closing metathesis (RCM) reaction to form a cross-linked ring
  MOD_RES (14)..(14): Non-natural electrophile containing amino acid or absent
XSTPXRRRLXRXFXRLQ

SEQ ID NO: 465 - protein, 14 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (10)..(10): Norleucine
  MOD_RES (12)..(12): Any non-natural amino acid which can be covalently joined "stapled together") using a ring-closing metathesis (RCM) reaction to form a cross-linked ring
  MOD_RES (14)..(14): Non-natural electrophile containing amino acid or absent
XAGTXLKRLXAXYX

SEQ ID NO: 466 - protein, 16 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (9)..(9): Any non-natural amino acid which can be covalently joined "stapled together") using a ring-closing metathesis (RCM) reaction to form a cross-linked ring
  MOD_RES (11)..(11): Non-natural electrophile containing amino acid or absent
XXLKRINRXLXDLGKD

SEQ ID NO: 467 - protein, 20 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (13)..(13): Any non-natural amino acid which can be covalently joined "stapled together") using a ring-closing metathesis (RCM) reaction to form a cross-linked ring
  MOD_RES (15)..(15): Non-natural electrophile containing amino acid or absent
XPSSAXEQLLRKXLXEIQKN

SEQ ID NO: 468 - protein, 19 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (11)..(11): Any non-natural amino acid which can be covalently joined "stapled together") using a ring-closing metathesis (RCM) reaction to form a cross-linked ring
  MOD_RES (14)..(14): Non-natural electrophile containing amino acid or absent
XANXAVQRIKXEFXEVLKS

SEQ ID NO: 469 - protein, 19 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (10)..(10): Norleucine
  MOD_RES (11)..(11): Any non-natural amino acid which can be covalently joined "stapled together") using a ring-closing metathesis (RCM) reaction to form a cross-linked ring
  MOD_RES (14)..(14): Non-natural electrophile containing amino acid or absent
XSTXARRRLXXDFXRLQED

SEQ ID NO: 470 - protein, 20 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (12)..(12): Any non-natural amino acid which can be covalently joined "stapled together") using a ring-closing metathesis (RCM) reaction to form a cross-linked ring
  MOD_RES (15)..(15): Non-natural electrophile containing amino acid or absent
XTELXSALLLRXQLXELNKN

SEQ ID NO: 471 - protein, 19 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (10)..(10): Norleucine
  MOD_RES (11)..(11): Any non-natural amino acid which can be covalently joined "stapled together") using a ring-closing metathesis (RCM) reaction to form a cross-linked ring
  MOD_RES (14)..(14): Non-natural electrophile containing amino acid or absent
XAGXALKRLXXEYXQLTLN

SEQ ID NO: 472 - protein, 23 aa, Artificial Sequence
  source: /note="Description of Artificial Sequence: Synthetic peptide"
  MOD_RES (1)..(1): Norleucine
  MOD_RES (8)..(8): Any non-natural amino acid which can be covalently joined "stapled together") using a ring-closing metathesis (RCM) reaction to form a cross-linked ring
  MOD_RES (15)..(15): Any non-natural amino acid which can be covalently joined "stapled together") using a ring-closing metathesis (RCM) reaction to form a cross-linked ring
  MOD_RES (18)..(18): Non-natural electrophile containing amino acid or absent
XARPLVPXSQKALLXELXGLQEE

SEQ ID NO: 473 - protein, 23 aa, Artificial Sequence
  source: /note="Description of Artificial Sequence: Synthetic peptide"
  MOD_RES (1)..(1): Norleucine
  MOD_RES (6)..(6): Norleucine
  MOD_RES (8)..(8): Any non-natural amino acid which can be covalently joined "stapled together") using a ring-closing metathesis (RCM) reaction to form a cross-linked ring
  MOD_RES (14)..(14): Norleucine
  MOD_RES (15)..(15): Any non-natural amino acid which can be covalently joined "stapled together") using a ring-closing metathesis (RCM) reaction to form a cross-linked ring
  MOD_RES (18)..(18): Non-natural electrophile containing amino acid or absent
XAQQQXTXSQKALXXELXSLQEE

SEQ ID NO: 474 - protein, 16 aa, Artificial Sequence
  source: /note="Description of Artificial Sequence: Synthetic peptide"
  MOD_RES (1)..(1): Any non-natural amino acid which can be covalently joined "stapled together") using a ring-closing metathesis (RCM) reaction to form a cross-linked ring
  MOD_RES (8)..(8): Any non-natural amino acid which can be covalently joined "stapled together") using a ring-closing metathesis (RCM) reaction to form a cross-linked ring
  MOD_RES (11)..(11): Non-natural electrophile containing amino acid or absent
XALKRIQXELXDLQRD

SEQ ID NO: 475 - protein, 16 aa, Artificial Sequence
  source: /note="Description of Artificial Sequence: Synthetic peptide"
  MOD_RES (1)..(1): Any non-natural amino acid which can be covalently joined "stapled together") using a ring-closing metathesis (RCM) reaction to form a cross-linked ring
  MOD_RES (8)..(8): Any non-natural amino acid which can be covalently joined "stapled together") using a ring-closing metathesis (RCM) reaction to form a cross-linked ring
  MOD_RES (11)..(11): Non-natural electrophile containing amino acid or absent
XALKRIHXELXDLARD

SEQ ID NO: 476 - protein, 16 aa, Artificial Sequence
  source: /note="Description of Artificial Sequence: Synthetic peptide"
  MOD_RES (1)..(1): Any non-natural amino acid which can be covalently joined "stapled together") using a ring-closing metathesis (RCM) reaction to form a cross-linked ring
  MOD_RES (8)..(8): Any non-natural amino acid which can be covalently joined "stapled together") using a ring-closing metathesis (RCM) reaction to form a cross-linked ring
  MOD_RES (11)..(11): Non-natural electrophile containing amino acid or absent
XALKRINXELXDLARD

SEQ ID NO: 477 - protein, 16 aa, Artificial Sequence
  source: /note="Description of Artificial Sequence: Synthetic peptide"
  MOD_RES (1)..(1): Any non-natural amino acid which can be covalently joined "stapled together") using a ring-closing metathesis (RCM) reaction to form a cross-linked ring
  MOD_RES (8)..(8): Any non-natural amino acid which can be covalently joined "stapled together") using a ring-closing metathesis (RCM) reaction to form a cross-linked ring
  MOD_RES (11)..(11): Non-natural electrophile containing amino acid or absent
XALKRIQXELXDLQRD

SEQ ID NO: 478 - protein, 23 aa, Artificial Sequence
  source: /note="Description of Artificial Sequence: Synthetic peptide"
  MOD_RES (8)..(8): Any non-natural amino acid which can be covalently joined "stapled together") using a ring-closing metathesis (RCM) reaction to form a cross-linked ring
  MOD_RES (15)..(15): Any non-natural amino acid which can be covalently joined "stapled together") using a ring-closing metathesis (RCM) reaction to form a cross-linked ring
  MOD_RES (18)..(18): Non-natural electrophile containing amino acid or absent
KNSKLLSXSAKRIQXELXDITLD

SEQ ID NO: 479 - protein, 23 aa, Artificial Sequence
  source: /note="Description of Artificial Sequence: Synthetic peptide"
  MOD_RES (8)..(8): Any non-natural amino acid which can be covalently joined "stapled together") using a ring-closing metathesis (RCM) reaction to form a cross-linked ring
  MOD_RES (15)..(15): Any non-natural amino acid which can be covalently joined "stapled together") using a ring-closing metathesis (RCM) reaction to form a cross-linked ring
  MOD_RES (18)..(18): Non-natural electrophile containing amino acid or absent
KTAAKLSXSAKRIQXELXEITLD

SEQ ID NO: 480 - protein, 23 aa, Artificial Sequence
  source: /note="Description of Artificial Sequence: Synthetic peptide"
  MOD_RES (8)..(8): Any non-natural amino acid which can be covalently joined "stapled together") using a ring-closing metathesis (RCM) reaction to form a cross-linked ring
  MOD_RES (15)..(15): Any non-natural amino acid which can be covalently joined "stapled together") using a ring-closing metathesis (RCM) reaction to form a cross-linked ring
  MOD_RES (18)..(18): Non-natural electrophile containing amino acid or absent
KTTAKLSXSAKRIQXELXEITLD

SEQ ID NO: 481 - protein, 20 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (12)..(12): Any non-natural amino acid which can be covalently joined "stapled together") using a ring-closing metathesis (RCM) reaction to form a cross-linked ring
  MOD_RES (15)..(15): Non-natural electrophile containing amino acid or absent
XHGRXYLLLHRXFCXLKENN

SEQ ID NO: 482 - protein, 25 aa, Artificial Sequence
  source: /note="Description of Artificial Sequence: Synthetic peptide"
  MOD_RES (1)..(1): Norleucine
  MOD_RES (10)..(10): Any non-natural amino acid which can be covalently joined "stapled together") using a ring-closing metathesis (RCM) reaction to form a cross-linked ring
  MOD_RES (16)..(16): Norleucine
  MOD_RES (17)..(17): Any non-natural amino acid which can be covalently joined "stapled together") using a ring-closing metathesis (RCM) reaction to form a cross-linked ring
  MOD_RES (20)..(20): Non-natural electrophile containing amino acid or absent
XETRYNLKSXAVKRLXXEAXELKDP

SEQ ID NO: 483 - protein, 27 aa, Artificial Sequence
  source: /note="Description of Artificial Sequence: Synthetic peptide"
  MOD_RES (1)..(1): Norleucine
  MOD_RES (12)..(12): Any non-natural amino acid which can be covalently joined "stapled together") using a ring-closing metathesis (RCM) reaction to form a cross-linked ring
  MOD_RES (19)..(19): Any non-natural amino acid which can be covalently joined "stapled together") using a ring-closing metathesis (RCM) reaction to form a cross-linked ring
  MOD_RES (22)..(22): Non-natural electrophile containing amino acid or absent
XSSTSSKRAPTXATQRLKXDYXRIKKD

SEQ ID NO: 484 - protein, 18 aa, Artificial Sequence
  source: /note="Description of Artificial Sequence: Synthetic peptide"
  MOD_RES (1)..(1): Norleucine
  MOD_RES (3)..(3): Any non-natural amino acid which can be covalently joined "stapled together") using a ring-closing metathesis (RCM) reaction to form a cross-linked ring
  MOD_RES (10)..(10): Any non-natural amino acid which can be covalently joined "stapled together") using a ring-closing metathesis (RCM) reaction to form a cross-linked ring
  MOD_RES (13)..(13): Non-natural electrophile containing amino acid or absent
XAXLPRRIIXETXRLLAE

SEQ ID NO: 485 - protein, 18 aa, Artificial Sequence
  source: /note="Description of Artificial Sequence: Synthetic peptide"
  MOD_RES (1)..(1): Norleucine
  MOD_RES (3)..(3): Any non-natural amino acid which can be covalently joined "stapled together") using a ring-closing metathesis (RCM) reaction to form a cross-linked ring
  MOD_RES (10)..(10): Any non-natural amino acid which can be covalently joined "stapled together") using a ring-closing metathesis (RCM) reaction to form a cross-linked ring
  MOD_RES (13)..(13): Non-natural electrophile containing amino acid or absent
XAXLPHRIIXETXRLLAE

SEQ ID NO: 486 - protein, 17 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (9)..(9): Any non-natural amino acid which can be covalently joined "stapled together") using a ring-closing metathesis (RCM) reaction to form a cross-linked ring
  MOD_RES (12)..(12): Non-natural electrophile containing amino acid or absent
  MOD_RES (13)..(13): Norleucine
XXRASRLKXELXXLATE

SEQ ID NO: 487 - protein, 27 aa, Artificial Sequence
  source: /note="Description of Artificial Sequence: Synthetic peptide"
  MOD_RES (1)..(1): Norleucine
  MOD_RES (12)..(12): Any non-natural amino acid which can be covalently joined "stapled together") using a ring-closing metathesis (RCM) reaction to form a cross-linked ring
  MOD_RES (19)..(19): Any non-natural amino acid which can be covalently joined "stapled together") using a ring-closing metathesis (RCM) reaction to form a cross-linked ring
  MOD_RES (22)..(22): Non-natural electrophile containing amino acid or absent
XAATTGSGVKVXRNFRLLXELXEGQKG

SEQ ID NO: 488 - protein, 25 aa, Artificial Sequence
  source: /note="Description of Artificial Sequence: Synthetic peptide"
  MOD_RES (1)..(1): Norleucine
  MOD_RES (10)..(10): Any non-natural amino acid which can be covalently joined "stapled together") using a ring-closing metathesis (RCM) reaction to form a cross-linked ring
  MOD_RES (17)..(17): Any non-natural amino acid which can be covalently joined "stapled together") using a ring-closing metathesis (RCM) reaction to form a cross-linked ring
  MOD_RES (20)..(20): Non-natural electrophile containing amino acid or absent
XAVSTGVKVXRNFRLLXELXEGQKG

SEQ ID NO: 489 - protein, 26 aa, Artificial Sequence
  source: /note="Description of Artificial Sequence: Synthetic peptide"
  MOD_RES (1)..(1): Norleucine
  MOD_RES (11)..(11): Any non-natural amino acid which can be covalently joined "stapled together") using a ring-closing metathesis (RCM) reaction to form a cross-linked ring
  MOD_RES (18)..(18): Any non-natural amino acid which can be covalently joined "stapled together") using a ring-closing metathesis (RCM) reaction to form a cross-linked ring
  MOD_RES (21)..(21): Non-natural electrophile containing amino acid or absent
XNSNVENLPPXIIRLVYXEVXTLTAD

SEQ ID NO: 490 - protein, 19 aa, Artificial Sequence
  source: /note="Description of Artificial Sequence: Synthetic peptide"
  MOD_RES (4)..(4): Any non-natural amino acid which can be covalently joined "stapled together") using a ring-closing metathesis (RCM) reaction to form a cross-linked ring
  MOD_RES (11)..(11): Any non-natural amino acid which can be covalently joined "stapled together") using a ring-closing metathesis (RCM) reaction to form a cross-linked ring
  MOD_RES (14)..(14): Non-natural electrophile containing amino acid or absent
  MOD_RES (17)..(17): Norleucine
  MOD_RES (18)..(18): Norleucine
ARGXVGKRLQXELXTLXXS

SEQ ID NO: 491 - protein, 18 aa, Artificial Sequence
  source: /note="Description of Artificial Sequence: Synthetic peptide"
  MOD_RES (1)..(1): Norleucine
  MOD_RES (3)..(3): Any non-natural amino acid which can be covalently joined "stapled together") using a ring-closing metathesis (RCM) reaction to form a cross-linked ring
  MOD_RES (4)..(4): Norleucine
  MOD_RES (10)..(10): Any non-natural amino acid which can be covalently joined "stapled together") using a ring-closing metathesis (RCM) reaction to form a cross-linked ring
  MOD_RES (13)..(13): Non-natural electrophile containing amino acid or absent
XAXXQKRLQXELXALQND

SEQ ID NO: 492 - protein, 18 aa, Artificial Sequence
  source: /note="Description of Artificial Sequence: Synthetic peptide"
  MOD_RES (3)..(3): Any non-natural amino acid which can be covalently joined "stapled together") using a ring-closing metathesis (RCM) reaction to form a cross-linked ring
  MOD_RES (10)..(10): Any non-natural amino acid which can be covalently joined "stapled together") using a ring-closing metathesis (RCM) reaction to form a cross-linked ring
  MOD_RES (12)..(12): Norleucine
  MOD_RES (13)..(13): Non-natural electrophile containing amino acid or absent
AKXFFSTVRXEXXLLATS

SEQ ID NO: 493 - protein, 23 aa, Artificial Sequence
  source: /note="Description of Artificial Sequence: Synthetic peptide"
  MOD_RES (8)..(8): Any non-natural amino acid which can be covalently joined "stapled together") using a ring-closing metathesis (RCM) reaction to form a cross-linked ring
  MOD_RES (15)..(15): Any non-natural amino acid which can be covalently joined "stapled together") using a ring-closing metathesis (RCM) reaction to form a cross-linked ring
  MOD_RES (18)..(18): Non-natural electrophile containing amino acid or absent
ANDANSAXRARRLAXEAXTLSTS

SEQ ID NO: 494 - protein, 17 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (8)..(8): Norleucine
  MOD_RES (9)..(9): Any non-natural amino acid which can be covalently joined "stapled together") using a ring-closing metathesis (RCM) reaction to form a cross-linked ring
  MOD_RES (12)..(12): Non-natural electrophile containing amino acid or absent
XXASRRLXXELXEIRKC

SEQ ID NO: 495 - protein, 17 aa, Artificial Sequence
  source: /note="Description of Artificial Sequence: Synthetic peptide"
  MOD_RES (1)..(1): Norleucine
  MOD_RES (2)..(2): Any non-natural amino acid which can be covalently joined "stapled together") using a ring-closing metathesis (RCM) reaction to form a cross-linked ring
  MOD_RES (5)..(5): Norleucine
  MOD_RES (9)..(9): Any non-natural amino acid which can be covalently joined "stapled together") using a ring-closing metathesis (RCM) reaction to form a cross-linked ring
  MOD_RES (12)..(12): Non-natural electrophile containing amino acid or absent
XXASXRVVXELXDLQKK

SEQ ID NO: 496 - protein, 19 aa, Artificial Sequence
  source: /note="Description of Artificial Sequence: Synthetic peptide"
  MOD_RES (4)..(4): Any non-natural amino acid which can be covalently joined "stapled together") using a ring-closing metathesis (RCM) reaction to form a cross-linked ring
  MOD_RES (11)..(11): Any non-natural amino acid which can be covalently joined "stapled together") using a ring-closing metathesis (RCM) reaction to form a cross-linked ring
  MOD_RES (14)..(14): Non-natural electrophile containing amino acid or absent
GPFXLEYSLLXEFXLVVKQ

SEQ ID NO: 497 - protein, 23 aa, Artificial Sequence
  source: /note="Description of Artificial Sequence: Synthetic peptide"
  MOD_RES (8)..(8): Any non-natural amino acid which can be covalently joined "stapled together") using a ring-closing metathesis (RCM) reaction to form a cross-linked ring
  MOD_RES (14)..(14): Norleucine
  MOD_RES (15)..(15): Any non-natural amino acid which can be covalently joined "stapled together") using a ring-closing metathesis (RCM) reaction to form a cross-linked ring
  MOD_RES (18)..(18): Non-natural electrophile containing amino acid or absent
GAVSGSVXATDRLXXELXDIYRS

SEQ ID NO: 498 - protein, 23 aa, Artificial Sequence
  source: /note="Description of Artificial Sequence: Synthetic peptide"
  MOD_RES (8)..(8): Any non-natural amino acid which can be covalently joined "stapled together") using a ring-closing metathesis (RCM) reaction to form a cross-linked ring
  MOD_RES (14)..(14): Norleucine
  MOD_RES (15)..(15): Any non-natural amino acid which can be covalently joined "stapled together") using a ring-closing metathesis (RCM) reaction to form a cross-linked ring
  MOD_RES (18)..(18): Non-natural electrophile containing amino acid or absent
GAVSGSVXASDRLXXELXDIYRS

SEQ ID NO: 499 - protein, 21 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (11)..(11): Norleucine
  MOD_RES (13)..(13): Any non-natural amino acid which can be covalently joined "stapled together") using a ring-closing metathesis (RCM) reaction to form a cross-linked ring
  MOD_RES (16)..(16): Non-natural electrophile containing amino acid or absent
XSSPSXGKRRXDXDVXKLIES

SEQ ID NO: 500 - protein, 17 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (10)..(10): Norleucine
  MOD_RES (11)..(11): Any non-natural amino acid which can be covalently joined "stapled together") using a ring-closing metathesis (RCM) reaction to form a cross-linked ring
  MOD_RES (14)..(14): Non-natural electrophile containing amino acid or absent
XSTXARRRLXXDFXRLQ

SEQ ID NO: 501 - protein, 14 aa, Artificial Sequence
  source: /note="Description of Artificial Sequence: Synthetic peptide"
  MOD_RES (1)..(1): Norleucine
  MOD_RES (4)..(4): Any non-natural amino acid which can be covalently joined "stapled together") using a ring-closing metathesis (RCM) reaction to form a cross-linked ring
  MOD_RES (10)..(10): Norleucine
  MOD_RES (11)..(11): Any non-natural amino acid which can be covalently joined "stapled together") using a ring-closing metathesis (RCM) reaction to form a cross-linked ring
  MOD_RES (14)..(14): Non-natural electrophile containing amino acid or absent
XAGXALKRLXXEYX

SEQ ID NO: 502 - protein, 16 aa, Artificial Sequence
  source: /note="Description of Artificial Sequence: Synthetic peptide"
  MOD_RES (1)..(1): Any non-natural amino acid which can be covalently joined "stapled together") using a ring-closing metathesis (RCM) reaction to form a cross-linked ring
  MOD_RES (8)..(8): Any non-natural amino acid which can be covalently joined "stapled together") using a ring-closing metathesis (RCM) reaction to form a cross-linked ring
  MOD_RES (11)..(11): Non-natural electrophile containing amino acid or absent
XALKRINXELXDLGKD

SEQ ID NO: 503 - protein, 20 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (12)..(12): Any non-natural amino acid which can be covalently joined "stapled together") using a ring-closing metathesis (RCM) reaction to form a cross-linked ring
  MOD_RES (15)..(15): Non-natural electrophile containing amino acid or absent
XPSSXSEQLLRXQLXEIQKN

SEQ ID NO: 504 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (11)..(11): Non-natural electrophile containing amino acid or absent
  MOD_RES (13)..(13): S-pentenyl alanine
XANIAXVQRIXRXFKEVLKS

SEQ ID NO: 505 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (11)..(11): Non-natural electrophile containing amino acid or absent
  MOD_RES (13)..(13): S-pentenyl alanine
XSTPAXRRRLXRXFKRLQED

SEQ ID NO: 506 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (11)..(11): Non-natural electrophile containing amino acid or absent
  MOD_RES (13)..(13): S-pentenyl alanine
XTELQXALLLXRXLAELNKN

SEQ ID NO: 507 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Non-natural electrophile containing amino acid or absent
  MOD_RES (12)..(12): S-pentenyl alanine
XAGTXLKRLXAXYKQLTLN

SEQ ID NO: 508 - protein, 23 aa, Artificial Sequence
  source: /note="Description of Artificial Sequence: Synthetic peptide"
  MOD_RES (1)..(1): Norleucine
  MOD_RES (9)..(9): R-octenyl alanine
  MOD_RES (14)..(14): Non-natural electrophile containing amino acid or absent
  MOD_RES (16)..(16): S-pentenyl alanine
XARPLVPSXQKALXLXLKGLQEE

SEQ ID NO: 509 - protein, 23 aa, Artificial Sequence
  source: /note="Description of Artificial Sequence: Synthetic peptide"
  MOD_RES (1)..(1): Norleucine
  MOD_RES (6)..(6): Norleucine
  MOD_RES (9)..(9): R-octenyl alanine
  MOD_RES (14)..(14): Non-natural electrophile containing amino acid or absent
  MOD_RES (16)..(16): S-pentenyl alanine
XAQQQXTSXQKALXLXLKSLQEE

SEQ ID NO: 510 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (7)..(7): Non-natural electrophile containing amino acid or absent
  MOD_RES (9)..(9): S-pentenyl alanine
XXLKRIXKXLSDLQRD

SEQ ID NO: 511 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (7)..(7): Non-natural electrophile containing amino acid or absent
  MOD_RES (9)..(9): S-pentenyl alanine
XXLKRIXKXLNDLARD

SEQ ID NO: 512 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (7)..(7): Non-natural electrophile containing amino acid or absent
  MOD_RES (9)..(9): S-pentenyl alanine
XXLKRIXKXLSDLARD

SEQ ID NO: 513 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (7)..(7): Non-natural electrophile containing amino acid or absent
  MOD_RES (9)..(9): S-pentenyl alanine
XXLKRIXKXLTDLQRD

SEQ ID NO: 514 - protein, 23 aa, Artificial Sequence
  source: /note="Description of Artificial Sequence: Synthetic peptide"
  MOD_RES (9)..(9): R-octenyl alanine
  MOD_RES (14)..(14): Non-natural electrophile containing amino acid or absent
  MOD_RES (16)..(16): S-pentenyl alanine
KNSKLLSTXAKRIXKXLADITLD

SEQ ID NO: 515 - protein, 23 aa, Artificial Sequence
  source: /note="Description of Artificial Sequence: Synthetic peptide"
  MOD_RES (9)..(9): R-octenyl alanine
  MOD_RES (14)..(14): Non-natural electrophile containing amino acid or absent
  MOD_RES (16)..(16): S-pentenyl alanine
KTAAKLSTXAKRIXKXLAEITLD

SEQ ID NO: 516 - protein, 23 aa, Artificial Sequence
  source: /note="Description of Artificial Sequence: Synthetic peptide"
  MOD_RES (9)..(9): R-octenyl alanine
  MOD_RES (14)..(14): Non-natural electrophile containing amino acid or absent
  MOD_RES (16)..(16): S-pentenyl alanine
KTTAKLSTXAKRIXKXLAEITLD

SEQ ID NO: 517 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (11)..(11): Non-natural electrophile containing amino acid or absent
  MOD_RES (13)..(13): S-pentenyl alanine
XHGRAXLLLHXDXCDLKENN

SEQ ID NO: 518 - protein, 25 aa, Artificial Sequence
  source: /note="Description of Artificial Sequence: Synthetic peptide"
  MOD_RES (1)..(1): Norleucine
  MOD_RES (11)..(11): R-octenyl alanine
  MOD_RES (16)..(16): Non-natural electrophile containing amino acid or absent
  MOD_RES (18)..(18): S-pentenyl alanine
XETRYNLKSPXVKRLXKXAAELKDP

SEQ ID NO: 519 - protein, 27 aa, Artificial Sequence
  source: /note="Description of Artificial Sequence: Synthetic peptide"
  MOD_RES (1)..(1): Norleucine
  MOD_RES (13)..(13): R-octenyl alanine
  MOD_RES (18)..(18): Non-natural electrophile containing amino acid or absent
  MOD_RES (20)..(20): S-pentenyl alanine
XSSTSSKRAPTTXTQRLXQXYLRIKKD

SEQ ID NO: 520 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (9)..(9): Non-natural electrophile containing amino acid or absent
  MOD_RES (11)..(11): S-pentenyl alanine
XAGXPRRIXKXTQRLLAE

SEQ ID NO: 521 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (9)..(9): Non-natural electrophile containing amino acid or absent
  MOD_RES (11)..(11): S-pentenyl alanine
XAEXPHRIXKXTQRLLAE

SEQ ID NO: 522 - protein, 17 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (8)..(8): Non-natural electrophile containing amino acid or absent
  MOD_RES (10)..(10): S-pentenyl alanine
  MOD_RES (13)..(13): Norleucine
XQXASRLXRXLHXLATE

SEQ ID NO: 523 - protein, 27 aa, Artificial Sequence
  source: /note="Description of Artificial Sequence: Synthetic peptide"
  MOD_RES (1)..(1): Norleucine
  MOD_RES (13)..(13): R-octenyl alanine
  MOD_RES (18)..(18): Non-natural electrophile containing amino acid or absent
  MOD_RES (20)..(20): S-pentenyl alanine
XAATTGSGVKVPXNFRLXEXLEEGQKG

SEQ ID NO: 524 - protein, 25 aa, Artificial Sequence
  source: /note="Description of Artificial Sequence: Synthetic peptide"
  MOD_RES (1)..(1): Norleucine
  MOD_RES (11)..(11): R-octenyl alanine
  MOD_RES (16)..(16): Non-natural electrophile containing amino acid or absent
  MOD_RES (18)..(18): S-pentenyl alanine
XAVSTGVKVPXNFRLXEXLEEGQKG

SEQ ID NO: 525 - protein, 26 aa, Artificial Sequence
  source: /note="Description of Artificial Sequence: Synthetic peptide"
  MOD_RES (1)..(1): Norleucine
  MOD_RES (12)..(12): R-octenyl alanine
  MOD_RES (17)..(17): Non-natural electrophile containing amino acid or absent
  MOD_RES (19)..(19): S-pentenyl alanine
XNSNVENLPPHXIRLVXKXVTTLTAD

SEQ ID NO: 526 - protein, 19 aa, Artificial Sequence
  source: /note="Description of Artificial Sequence: Synthetic peptide"
  MOD_RES (5)..(5): R-octenyl alanine
  MOD_RES (10)..(10): Non-natural electrophile containing amino acid or absent
  MOD_RES (12)..(12): S-pentenyl alanine
  MOD_RES (14)..(14): Norleucine
  MOD_RES (17)..(17): Norleucine
  MOD_RES (18)..(18): Norleucine
ARGPXGKRLXQXLXTLXXS

SEQ ID NO: 527 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (9)..(9): Non-natural electrophile containing amino acid or absent
  MOD_RES (11)..(11): S-pentenyl alanine
XASXQKRLXKXLLALQND

SEQ ID NO: 528 - protein, 18 aa, Artificial Sequence
  source: /note="Description of Artificial Sequence: Synthetic peptide"
  MOD_RES (4)..(4): R-octenyl alanine
  MOD_RES (9)..(9): Non-natural electrophile containing amino acid or absent
  MOD_RES (11)..(11): S-pentenyl alanine
  MOD_RES (12)..(12): Norleucine
AKKXFSTVXKXXALLATS

SEQ ID NO: 529 - protein, 23 aa, Artificial Sequence
  source: /note="Description of Artificial Sequence: Synthetic peptide"
  MOD_RES (9)..(9): R-octenyl alanine
  MOD_RES (14)..(14): Non-natural electrophile containing amino acid or absent
  MOD_RES (16)..(16): S-pentenyl alanine
ANDANSAAXARRLXQXAVTLSTS

SEQ ID NO: 530 - protein, 17 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (8)..(8): Non-natural electrophile containing amino acid or absent
  MOD_RES (10)..(10): S-pentenyl alanine
XAXSRRLXKXLEEIRKC

SEQ ID NO: 531 - protein, 17 aa, Artificial Sequence
  source: /note="Description of Artificial Sequence: Synthetic peptide"
  MOD_RES (1)..(1): Norleucine
  MOD_RES (2)..(2): Norleucine
  MOD_RES (3)..(3): R-octenyl alanine
  MOD_RES (5)..(5): Norleucine
  MOD_RES (8)..(8): Non-natural electrophile containing amino acid or absent
  MOD_RES (10)..(10): S-pentenyl alanine
XXXSXRVXKXLEDLQKK

SEQ ID NO: 532 - protein, 19 aa, Artificial Sequence
  source: /note="Description of Artificial Sequence: Synthetic peptide"
  MOD_RES (5)..(5): R-octenyl alanine
  MOD_RES (10)..(10): Non-natural electrophile containing amino acid or absent
  MOD_RES (12)..(12): S-pentenyl alanine
GPFYXEYSLXAXFTLVVKQ

SEQ ID NO: 533 - protein, 23 aa, Artificial Sequence
  source: /note="Description of Artificial Sequence: Synthetic peptide"
  MOD_RES (9)..(9): R-octenyl alanine
  MOD_RES (14)..(14): Non-natural electrophile containing amino acid or absent
  MOD_RES (16)..(16): S-pentenyl alanine
GAVSGSVQXTDRLXKXLRDIYRS

SEQ ID NO: 534 - protein, 23 aa, Artificial Sequence
  source: /note="Description of Artificial Sequence: Synthetic peptide"
  MOD_RES (9)..(9): R-octenyl alanine
  MOD_RES (14)..(14): Non-natural electrophile containing amino acid or absent
  MOD_RES (16)..(16): S-pentenyl alanine
GAVSGSVQXSDRLXKXLRDIYRS

SEQ ID NO: 535 - protein, 21 aa, Artificial Sequence
  source: /note="Description of Artificial Sequence: Synthetic peptide"
  MOD_RES (1)..(1): Norleucine
  MOD_RES (7)..(7): R-octenyl alanine
  MOD_RES (11)..(11): Norleucine
  MOD_RES (12)..(12): Non-natural electrophile containing amino acid or absent
  MOD_RES (14)..(14): S-pentenyl alanine
XSSPSPXKRRXXTXVVKLIES

SEQ ID NO: 536 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Non-natural electrophile containing amino acid or absent
  MOD_RES (12)..(12): S-pentenyl alanine
XSTPXRRRLXRXFKRLQ

SEQ ID NO: 537 - protein, 14 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Non-natural electrophile containing amino acid or absent
  MOD_RES (12)..(12): S-pentenyl alanine
XAGTXLKRLXAXYK

SEQ ID NO: 538 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (7)..(7): Non-natural electrophile containing amino acid or absent
  MOD_RES (9)..(9): S-pentenyl alanine
XXLKRIXRXLADLGKD

SEQ ID NO: 539 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (11)..(11): Non-natural electrophile containing amino acid or absent
  MOD_RES (13)..(13): S-pentenyl alanine
XPSSAXEQLLXKXLKEIQKN

SEQ ID NO: 540 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (11)..(11): Non-natural electrophile containing amino acid or absent
  MOD_RES (12)..(12): S-pentenyl alanine
XANIXVQRIKXXFKEVLKS

SEQ ID NO: 541 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (11)..(11): Non-natural electrophile containing amino acid or absent
  MOD_RES (12)..(12): S-pentenyl alanine
XSTPXRRRLXXXFKRLQED

SEQ ID NO: 542 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (12)..(12): Non-natural electrophile containing amino acid or absent
  MOD_RES (13)..(13): S-pentenyl alanine
XTELQXALLLRXXLAELNKN

SEQ ID NO: 543 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (11)..(11): Non-natural electrophile containing amino acid or absent
  MOD_RES (12)..(12): S-pentenyl alanine
XAGTXLKRLXXXYKQLTLN

SEQ ID NO: 544 - protein, 23 aa, Artificial Sequence
  source: /note="Description of Artificial Sequence: Synthetic peptide"
  MOD_RES (1)..(1): Norleucine
  MOD_RES (9)..(9): R-octenyl alanine
  MOD_RES (15)..(15): Non-natural electrophile containing amino acid or absent
  MOD_RES (16)..(16): S-pentenyl alanine
XARPLVPSXQKALLXXLKGLQEE

SEQ ID NO: 545 - protein, 23 aa, Artificial Sequence
  source: /note="Description of Artificial Sequence: Synthetic peptide"
  MOD_RES (1)..(1): Norleucine
  MOD_RES (6)..(6): Norleucine
  MOD_RES (9)..(9): R-octenyl alanine
  MOD_RES (14)..(14): Norleucine
  MOD_RES (15)..(15): Non-natural electrophile containing amino acid or absent
  MOD_RES (16)..(16): S-pentenyl alanine
XAQQQXTSXQKALXXXLKSLQEE

SEQ ID NO: 546 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (8)..(8): Non-natural electrophile containing amino acid or absent
  MOD_RES (9)..(9): S-pentenyl alanine
XXLKRIQXXLSDLQRD

SEQ ID NO: 547 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (8)..(8): Non-natural electrophile containing amino acid or absent
  MOD_RES (9)..(9): S-pentenyl alanine
XXLKRIHXXLNDLARD

SEQ ID NO: 548 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (8)..(8): Non-natural electrophile containing amino acid or absent
  MOD_RES (9)..(9): S-pentenyl alanine
XXLKRINXXLSDLARD

SEQ ID NO: 549 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (8)..(8): Non-natural electrophile containing amino acid or absent
  MOD_RES (9)..(9): S-pentenyl alanine
XXLKRIQXXLTDLQRD

SEQ ID NO: 550 - protein, 23 aa, Artificial Sequence
  source: /note="Description of Artificial Sequence: Synthetic peptide"
  MOD_RES (9)..(9): R-octenyl alanine
  MOD_RES (15)..(15): Non-natural electrophile containing amino acid or absent
  MOD_RES (16)..(16): S-pentenyl alanine
KNSKLLSTXAKRIQXXLADITLD

SEQ ID NO: 551 - protein, 23 aa, Artificial Sequence
  source: /note="Description of Artificial Sequence: Synthetic peptide"
  MOD_RES (9)..(9): R-octenyl alanine
  MOD_RES (15)..(15): Non-natural electrophile containing amino acid or absent
  MOD_RES (16)..(16): S-pentenyl alanine
KTAAKLSTXAKRIQXXLAEITLD

SEQ ID NO: 552 - protein, 23 aa, Artificial Sequence
  source: /note="Description of Artificial Sequence: Synthetic peptide"
  MOD_RES (9)..(9): R-octenyl alanine
  MOD_RES (15)..(15): Non-natural electrophile containing amino acid or absent
  MOD_RES (16)..(16): S-pentenyl alanine
KTTAKLSTXAKRIQXXLAEITLD

SEQ ID NO: 553 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (12)..(12): Non-natural electrophile containing amino acid or absent
  MOD_RES (13)..(13): S-pentenyl alanine
XHGRAXLLLHRXXCDLKENN

SEQ ID NO: 554 - protein, 25 aa, Artificial Sequence
  source: /note="Description of Artificial Sequence: Synthetic peptide"
  MOD_RES (1)..(1): Norleucine
  MOD_RES (11)..(11): R-octenyl alanine
  MOD_RES (16)..(16): Norleucine
  MOD_RES (17)..(17): Non-natural electrophile containing amino acid or absent
  MOD_RES (18)..(18): S-pentenyl alanine
XETRYNLKSPXVKRLXXXAAELKDP

SEQ ID NO: 555 - protein, 27 aa, Artificial Sequence
  source: /note="Description of Artificial Sequence: Synthetic peptide"
  MOD_RES (1)..(1): Norleucine
  MOD_RES (13)..(13): R-octenyl alanine
  MOD_RES (19)..(19): Non-natural electrophile containing amino acid or absent
  MOD_RES (20)..(20): S-pentenyl alanine
XSSTSSKRAPTTXTQRLKXXYLRIKKD

SEQ ID NO: 556 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (10)..(10): Non-natural electrophile containing amino acid or absent
  MOD_RES (11)..(11): S-pentenyl alanine
XAGXPRRIIXXTQRLLAE

SEQ ID NO: 557 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (10)..(10): Non-natural electrophile containing amino acid or absent
  MOD_RES (11)..(11): S-pentenyl alanine
XAEXPHRIIXXTQRLLAE

SEQ ID NO: 558 - protein, 17 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (9)..(9): Non-natural electrophile containing amino acid or absent
  MOD_RES (10)..(10): S-pentenyl alanine
  MOD_RES (13)..(13): Norleucine
XQXASRLKXXLHXLATE

SEQ ID NO: 559 - protein, 27 aa, Artificial Sequence
  source: /note="Description of Artificial Sequence: Synthetic peptide"
  MOD_RES (1)..(1): Norleucine
  MOD_RES (13)..(13): R-octenyl alanine
  MOD_RES (19)..(19): Non-natural electrophile containing amino acid or absent
  MOD_RES (20)..(20): S-pentenyl alanine
XAATTGSGVKVPXNFRLLXXLEEGQKG

SEQ ID NO: 560 - protein, 25 aa, Artificial Sequence
  source: /note="Description of Artificial Sequence: Synthetic peptide"
  MOD_RES (1)..(1): Norleucine
  MOD_RES (11)..(11): R-octenyl alanine
  MOD_RES (17)..(17): Non-natural electrophile containing amino acid or absent
  MOD_RES (18)..(18): S-pentenyl alanine
XAVSTGVKVPXNFRLLXXLEEGQKG

SEQ ID NO: 561 - protein, 26 aa, Artificial Sequence
  source: /note="Description of Artificial Sequence: Synthetic peptide"
  MOD_RES (1)..(1): Norleucine
  MOD_RES (12)..(12): R-octenyl alanine
  MOD_RES (18)..(18): Non-natural electrophile containing amino acid or absent
  MOD_RES (19)..(19): S-pentenyl alanine
XNSNVENLPPHXIRLVYXXVTTLTAD

SEQ ID NO: 562 - protein, 19 aa, Artificial Sequence
  source: /note="Description of Artificial Sequence: Synthetic peptide"
  MOD_RES (5)..(5): R-octenyl alanine
  MOD_RES (11)..(11): Non-natural electrophile containing amino acid or absent
  MOD_RES (12)..(12): S-pentenyl alanine
  MOD_RES (14)..(14): Norleucine
  MOD_RES (17)..(17): Norleucine
  MOD_RES (18)..(18): Norleucine
ARGPXGKRLQXXLXTLXXS

SEQ ID NO: 563 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (10)..(10): Non-natural electrophile containing amino acid or absent
  MOD_RES (11)..(11): S-pentenyl alanine
XASXQKRLQXXLLALQND

SEQ ID NO: 564 - protein, 18 aa, Artificial Sequence
  source: /note="Description of Artificial Sequence: Synthetic peptide"
  MOD_RES (4)..(4): R-octenyl alanine
  MOD_RES (10)..(10): Non-natural electrophile containing amino acid or absent
  MOD_RES (11)..(11): S-pentenyl alanine
  MOD_RES (12)..(12): Norleucine
AKKXFSTVRXXXALLATS

SEQ ID NO: 565 - protein, 23 aa, Artificial Sequence
  source: /note="Description of Artificial Sequence: Synthetic peptide"
  MOD_RES (9)..(9): R-octenyl alanine
  MOD_RES (15)..(15): Non-natural electrophile containing amino acid or absent
  MOD_RES (16)..(16): S-pentenyl alanine
ANDANSAAXARRLAXXAVTLSTS

SEQ ID NO: 566 - protein, 17 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (8)..(8): Norleucine
  MOD_RES (9)..(9): Non-natural electrophile containing amino acid or absent
  MOD_RES (10)..(10): S-pentenyl alanine
XAXSRRLXXXLEEIRKC

SEQ ID NO: 567 - protein, 17 aa, Artificial Sequence
  source: /note="Description of Artificial Sequence: Synthetic peptide"
  MOD_RES (1)..(1): Norleucine
  MOD_RES (2)..(2): Norleucine
  MOD_RES (3)..(3): R-octenyl alanine
  MOD_RES (5)..(5): Norleucine
  MOD_RES (9)..(9): Non-natural electrophile containing amino acid or absent
  MOD_RES (10)..(10): S-pentenyl alanine
XXXSXRVVXXLEDLQKK

SEQ ID NO: 568 - protein, 19 aa, Artificial Sequence
  source: /note="Description of Artificial Sequence: Synthetic peptide"
  MOD_RES (5)..(5): R-octenyl alanine
  MOD_RES (11)..(11): Non-natural electrophile containing amino acid or absent
  MOD_RES (12)..(12): S-pentenyl alanine
GPFYXEYSLLXXFTLVVKQ

SEQ ID NO: 569 - protein, 23 aa, Artificial Sequence
  source: /note="Description of Artificial Sequence: Synthetic peptide"
  MOD_RES (9)..(9): R-octenyl alanine
  MOD_RES (14)..(14): Norleucine
  MOD_RES (15)..(15): Non-natural electrophile containing amino acid or absent
  MOD_RES (16)..(16): S-pentenyl alanine
GAVSGSVQXTDRLXXXLRDIYRS

SEQ ID NO: 570 - protein, 23 aa, Artificial Sequence
  source: /note="Description of Artificial Sequence: Synthetic peptide"
  MOD_RES (9)..(9): R-octenyl alanine
  MOD_RES (14)..(14): Norleucine
  MOD_RES (15)..(15): Non-natural electrophile containing amino acid or absent
  MOD_RES (16)..(16): S-pentenyl alanine
GAVSGSVQXSDRLXXXLRDIYRS

SEQ ID NO: 571 - protein, 21 aa, Artificial Sequence
  source: /note="Description of Artificial Sequence: Synthetic peptide"
  MOD_RES (1)..(1): Norleucine
  MOD_RES (7)..(7): R-octenyl alanine
  MOD_RES (11)..(11): Norleucine
  MOD_RES (13)..(13): Non-natural electrophile containing amino acid or absent
  MOD_RES (14)..(14): S-pentenyl alanine
XSSPSPXKRRXDXXVVKLIES

SEQ ID NO: 572 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (11)..(11): Non-natural electrophile containing amino acid or absent
  MOD_RES (12)..(12): S-pentenyl alanine
XSTPXRRRLXXXFKRLQ

SEQ ID NO: 573 - protein, 14 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (11)..(11): Non-natural electrophile containing amino acid or absent
  MOD_RES (12)..(12): S-pentenyl alanine
XAGTXLKRLXXXYK

SEQ ID NO: 574 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (8)..(8): Non-natural electrophile containing amino acid or absent
  MOD_RES (9)..(9): S-pentenyl alanine
XXLKRINXXLADLGKD

SEQ ID NO: 575 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (12)..(12): Non-natural electrophile containing amino acid or absent
  MOD_RES (13)..(13): S-pentenyl alanine
XPSSAXEQLLRXXLKEIQKN

SEQ ID NO: 576 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (12)..(12): S-pentenyl alanine
  MOD_RES (14)..(14): Non-natural electrophile containing amino acid or absent
XANIXVQRIKRXFXEVLKS

SEQ ID NO: 577 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
  MOD_RES (14)..(14): Non-natural electrophile containing amino acid or absent
XSTPXRRRLXRXFXRLQED

SEQ ID NO: 578 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (13)..(13): S-pentenyl alanine
  MOD_RES (15)..(15): Non-natural electrophile containing amino acid or absent
XTELQXALLLRRXLXELNKN

SEQ ID NO: 579 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
  MOD_RES (14)..(14): Non-natural electrophile containing amino acid or absent
XAGTXLKRLXAXYXQLTLN

SEQ ID NO: 580 - protein, 23 aa, Artificial Sequence
  source: /note="Description of Artificial Sequence: Synthetic peptide"
  MOD_RES (1)..(1): Norleucine
  MOD_RES (9)..(9): R-octenyl alanine
  MOD_RES (16)..(16): S-pentenyl alanine
  MOD_RES (18)..(18): Non-natural electrophile containing amino acid or absent
XARPLVPSXQKALLLXLXGLQEE

SEQ ID NO: 581 - protein, 23 aa, Artificial Sequence
  source: /note="Description of Artificial Sequence: Synthetic peptide"
  MOD_RES (1)..(1): Norleucine
  MOD_RES (6)..(6): Norleucine
  MOD_RES (9)..(9): R-octenyl alanine
  MOD_RES (14)..(14): Norleucine
  MOD_RES (16)..(16): S-pentenyl alanine
  MOD_RES (18)..(18): Non-natural electrophile containing amino acid or absent
XAQQQXTSXQKALXLXLXSLQEE

SEQ ID NO: 582 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (9)..(9): S-pentenyl alanine
  MOD_RES (11)..(11): Non-natural electrophile containing amino acid or absent
XXLKRIQKXLXDLQRD

SEQ ID NO: 583 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (9)..(9): S-pentenyl alanine
  MOD_RES (11)..(11): Non-natural electrophile containing amino acid or absent
XXLKRIHKXLXDLARD

SEQ ID NO: 584 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (9)..(9): S-pentenyl alanine
  MOD_RES (11)..(11): Non-natural electrophile containing amino acid or absent
XXLKRINKXLXDLARD

SEQ ID NO: 585 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (9)..(9): S-pentenyl alanine
  MOD_RES (11)..(11): Non-natural electrophile containing amino acid or absent
XXLKRIQKXLXDLQRD

SEQ ID NO: 586 - protein, 23 aa, Artificial Sequence
  source: /note="Description of Artificial Sequence: Synthetic peptide"
  MOD_RES (9)..(9): R-octenyl alanine
  MOD_RES (16)..(16): S-pentenyl alanine
  MOD_RES (18)..(18): Non-natural electrophile containing amino acid or absent
KNSKLLSTXAKRIQKXLXDITLD

SEQ ID NO: 587 - protein, 23 aa, Artificial Sequence
  source: /note="Description of Artificial Sequence: Synthetic peptide"
  MOD_RES (9)..(9): R-octenyl alanine
  MOD_RES (16)..(16): S-pentenyl alanine
  MOD_RES (18)..(18): Non-natural electrophile containing amino acid or absent
KTAAKLSTXAKRIQKXLXEITLD

SEQ ID NO: 588 - protein, 23 aa, Artificial Sequence
  source: /note="Description of Artificial Sequence: Synthetic peptide"
  MOD_RES (9)..(9): R-octenyl alanine
  MOD_RES (16)..(16): S-pentenyl alanine
  MOD_RES (18)..(18): Non-natural electrophile containing amino acid or absent
KTTAKLSTXAKRIQKXLXEITLD

SEQ ID NO: 589 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (13)..(13): S-pentenyl alanine
  MOD_RES (15)..(15): Non-natural electrophile containing amino acid or absent
XHGRAXLLLHRDXCXLKENN

SEQ ID NO: 590 - protein, 25 aa, Artificial Sequence
  source: /note="Description of Artificial Sequence: Synthetic peptide"
  MOD_RES (1)..(1): Norleucine
  MOD_RES (11)..(11): R-octenyl alanine
  MOD_RES (16)..(16): Norleucine
  MOD_RES (18)..(18): S-pentenyl alanine
  MOD_RES (20)..(20): Non-natural electrophile containing amino acid or absent
XETRYNLKSPXVKRLXKXAXELKDP

SEQ ID NO: 591 - protein, 27 aa, Artificial Sequence
  source: /note="Description of Artificial Sequence: Synthetic peptide"
  MOD_RES (1)..(1): Norleucine
  MOD_RES (13)..(13): R-octenyl alanine
  MOD_RES (20)..(20): S-pentenyl alanine
  MOD_RES (22)..(22): Non-natural electrophile containing amino acid or absent
XSSTSSKRAPTTXTQRLKQXYXRIKKD

SEQ ID NO: 592 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (11)..(11): S-pentenyl alanine
  MOD_RES (13)..(13): Non-natural electrophile containing amino acid or absent
XAGXPRRIIKXTXRLLAE

SEQ ID NO: 593 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (11)..(11): S-pentenyl alanine
  MOD_RES (13)..(13): Non-natural electrophile containing amino acid or absent
XAEXPHRIIKXTXRLLAE

SEQ ID NO: 594 - protein, 17 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (10)..(10): S-pentenyl alanine
  MOD_RES (12)..(12): Non-natural electrophile containing amino acid or absent
  MOD_RES (13)..(13): Norleucine
XQXASRLKRXLXXLATE

SEQ ID NO: 595 - protein, 27 aa, Artificial Sequence
  source: /note="Description of Artificial Sequence: Synthetic peptide"
  MOD_RES (1)..(1): Norleucine
  MOD_RES (13)..(13): R-octenyl alanine
  MOD_RES (20)..(20): S-pentenyl alanine
  MOD_RES (22)..(22): Non-natural electrophile containing amino acid or absent
XAATTGSGVKVPXNFRLLEXLXEGQKG

SEQ ID NO: 596 - protein, 25 aa, Artificial Sequence
  source: /note="Description of Artificial Sequence: Synthetic peptide"
  MOD_RES (1)..(1): Norleucine
  MOD_RES (11)..(11): R-octenyl alanine
  MOD_RES (18)..(18): S-pentenyl alanine
  MOD_RES (20)..(20): Non-natural electrophile containing amino acid or absent
XAVSTGVKVPXNFRLLEXLXEGQKG

SEQ ID NO: 597 - protein, 26 aa, Artificial Sequence
  source: /note="Description of Artificial Sequence: Synthetic peptide"
  MOD_RES (1)..(1): Norleucine
  MOD_RES (12)..(12): R-octenyl alanine
  MOD_RES (19)..(19): S-pentenyl alanine
  MOD_RES (21)..(21): Non-natural electrophile containing amino acid or absent
XNSNVENLPPHXIRLVYKXVXTLTAD

SEQ ID NO: 598 - protein, 19 aa, Artificial Sequence
  source: /note="Description of Artificial Sequence: Synthetic peptide"
  MOD_RES (5)..(5): R-octenyl alanine
  MOD_RES (12)..(12): S-pentenyl alanine
  MOD_RES (14)..(14): Non-natural electrophile containing amino acid or absent
  MOD_RES (17)..(17): Norleucine
  MOD_RES (18)..(18): Norleucine
ARGPXGKRLQQXLXTLXXS

SEQ ID NO: 599 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (11)..(11): S-pentenyl alanine
  MOD_RES (13)..(13): Non-natural electrophile containing amino acid or absent
XASXQKRLQKXLXALQND

SEQ ID NO: 600 - protein, 18 aa, Artificial Sequence
  source: /note="Description of Artificial Sequence: Synthetic peptide"
  MOD_RES (4)..(4): R-octenyl alanine
  MOD_RES (11)..(11): S-pentenyl alanine
  MOD_RES (12)..(12): Norleucine
  MOD_RES (13)..(13): Non-natural electrophile containing amino acid or absent
AKKXFSTVRKXXXLLATS

SEQ ID NO: 601 - protein, 23 aa, Artificial Sequence
  source: /note="Description of Artificial Sequence: Synthetic peptide"
  MOD_RES (9)..(9): R-octenyl alanine
  MOD_RES (16)..(16): S-pentenyl alanine
  MOD_RES (18)..(18): Non-natural electrophile containing amino acid or absent
ANDANSAAXARRLAQXAXTLSTS

SEQ ID NO: 602 - protein, 17 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (8)..(8): Norleucine
  MOD_RES (10)..(10): S-pentenyl alanine
  MOD_RES (12)..(12): Non-natural electrophile containing amino acid or absent
XAXSRRLXKXLXEIRKC

SEQ ID NO: 603 - protein, 17 aa, Artificial Sequence
  source: /note="Description of Artificial Sequence: Synthetic peptide"
  MOD_RES (1)..(1): Norleucine
  MOD_RES (2)..(2): Norleucine
  MOD_RES (3)..(3): R-octenyl alanine
  MOD_RES (5)..(5): Norleucine
  MOD_RES (10)..(10): S-pentenyl alanine
  MOD_RES (12)..(12): Non-natural electrophile containing amino acid or absent
XXXSXRVVKXLXDLQKK

SEQ ID NO: 604 - protein, 19 aa, Artificial Sequence
  source: /note="Description of Artificial Sequence: Synthetic peptide"
  MOD_RES (5)..(5): R-octenyl alanine
  MOD_RES (12)..(12): S-pentenyl alanine
  MOD_RES (14)..(14): Non-natural electrophile containing amino acid or absent
GPFYXEYSLLAXFXLVVKQ

SEQ ID NO: 605 - protein, 23 aa, Artificial Sequence
  source: /note="Description of Artificial Sequence: Synthetic peptide"
  MOD_RES (9)..(9): R-octenyl alanine
  MOD_RES (14)..(14): Norleucine
  MOD_RES (16)..(16): S-pentenyl alanine
  MOD_RES (18)..(18): Non-natural electrophile containing amino acid or absent
GAVSGSVQXTDRLXKXLXDIYRS

SEQ ID NO: 606 - protein, 23 aa, Artificial Sequence
  source: /note="Description of Artificial Sequence: Synthetic peptide"
  MOD_RES (9)..(9): R-octenyl alanine
  MOD_RES (14)..(14): Norleucine
  MOD_RES (16)..(16): S-pentenyl alanine
  MOD_RES (18)..(18): Non-natural electrophile containing amino acid or absent
GAVSGSVQXSDRLXKXLXDIYRS

SEQ ID NO: 607 - protein, 21 aa, Artificial Sequence
  source: /note="Description of Artificial Sequence: Synthetic peptide"
  MOD_RES (1)..(1): Norleucine
  MOD_RES (7)..(7): R-octenyl alanine
  MOD_RES (11)..(11): Norleucine
  MOD_RES (14)..(14): S-pentenyl alanine
  MOD_RES (16)..(16): Non-natural electrophile containing amino acid or absent
XSSPSPXKRRXDTXVXKLIES

SEQ ID NO: 608 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
  MOD_RES (14)..(14): Non-natural electrophile containing amino acid or absent
XSTPXRRRLXRXFXRLQ

SEQ ID NO: 609 - protein, 14 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
  MOD_RES (14)..(14): Non-natural electrophile containing amino acid or absent
XAGTXLKRLXAXYX

SEQ ID NO: 610 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (9)..(9): S-pentenyl alanine
  MOD_RES (11)..(11): Non-natural electrophile containing amino acid or absent
XXLKRINRXLXDLGKD

SEQ ID NO: 611 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (13)..(13): S-pentenyl alanine
  MOD_RES (15)..(15): Non-natural electrophile containing amino acid or absent
XPSSAXEQLLRKXLXEIQKN

SEQ ID NO: 612 - protein, 19 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (11)..(11): S-pentenyl alanine
  MOD_RES (14)..(14): Non-natural electrophile containing amino acid or absent
XANXAVQRIKXEFXEVLKS

SEQ ID NO: 613 - protein, 19 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (10)..(10): Norleucine
  MOD_RES (11)..(11): S-pentenyl alanine
  MOD_RES (14)..(14): Non-natural electrophile containing amino acid or absent
XSTXARRRLXXDFXRLQED

SEQ ID NO: 614 - protein, 20 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (12)..(12): S-pentenyl alanine
  MOD_RES (15)..(15): Non-natural electrophile containing amino acid or absent
XTELXSALLLRXQLXELNKN

SEQ ID NO: 615 - protein, 19 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (10)..(10): Norleucine
  MOD_RES (11)..(11): S-pentenyl alanine
  MOD_RES (14)..(14): Non-natural electrophile containing amino acid or absent
XAGXALKRLXXEYXQLTLN

SEQ ID NO: 616 - protein, 23 aa, Artificial Sequence
  source: /note="Description of Artificial Sequence: Synthetic peptide"
  MOD_RES (1)..(1): Norleucine
  MOD_RES (8)..(8): R-octenyl alanine
  MOD_RES (15)..(15): S-pentenyl alanine
  MOD_RES (18)..(18): Non-natural electrophile containing amino acid or absent
XARPLVPXSQKALLXELXGLQEE

SEQ ID NO: 617 - protein, 23 aa, Artificial Sequence
  source: /note="Description of Artificial Sequence: Synthetic peptide"
  MOD_RES (1)..(1): Norleucine
  MOD_RES (6)..(6): Norleucine
  MOD_RES (8)..(8): R-octenyl alanine
  MOD_RES (14)..(14): Norleucine
  MOD_RES (15)..(15): S-pentenyl alanine
  MOD_RES (18)..(18): Non-natural electrophile containing amino acid or absent
XAQQQXTXSQKALXXELXSLQEE

SEQ ID NO: 618 - protein, 16 aa, Artificial Sequence
  source: /note="Description of Artificial Sequence: Synthetic peptide"
  MOD_RES (1)..(1): R-octenyl alanine
  MOD_RES (8)..(8): S-pentenyl alanine
  MOD_RES (11)..(11): Non-natural electrophile containing amino acid or absent
XALKRIQXELXDLQRD

SEQ ID NO: 619 - protein, 16 aa, Artificial Sequence
  source: /note="Description of Artificial Sequence: Synthetic peptide"
  MOD_RES (1)..(1): R-octenyl alanine
  MOD_RES (8)..(8): S-pentenyl alanine
  MOD_RES (11)..(11): Non-natural electrophile containing amino acid or absent
XALKRIHXELXDLARD

SEQ ID NO: 620 - protein, 16 aa, Artificial Sequence
  source: /note="Description of Artificial Sequence: Synthetic peptide"
  MOD_RES (1)..(1): R-octenyl alanine
  MOD_RES (8)..(8): S-pentenyl alanine
  MOD_RES (11)..(11): Non-natural electrophile containing amino acid or absent
XALKRINXELXDLARD

SEQ ID NO: 621 - protein, 16 aa, Artificial Sequence
  source: /note="Description of Artificial Sequence: Synthetic peptide"
  MOD_RES (1)..(1): R-octenyl alanine
  MOD_RES (8)..(8): S-pentenyl alanine
  MOD_RES (11)..(11): Non-natural electrophile containing amino acid or absent
XALKRIQXELXDLQRD

SEQ ID NO: 622 - protein, 23 aa, Artificial Sequence
  source: /note="Description of Artificial Sequence: Synthetic peptide"
  MOD_RES (8)..(8): R-octenyl alanine
  MOD_RES (15)..(15): S-pentenyl alanine
  MOD_RES (18)..(18): Non-natural electrophile containing amino acid or absent
KNSKLLSXSAKRIQXELXDITLD

SEQ ID NO: 623 - protein, 23 aa, Artificial Sequence
  source: /note="Description of Artificial Sequence: Synthetic peptide"
  MOD_RES (8)..(8): R-octenyl alanine
  MOD_RES (15)..(15): S-pentenyl alanine
  MOD_RES (18)..(18): Non-natural electrophile containing amino acid or absent
KTAAKLSXSAKRIQXELXEITLD

SEQ ID NO: 624 - protein, 23 aa, Artificial Sequence
  source: /note="Description of Artificial Sequence: Synthetic peptide"
  MOD_RES (8)..(8): R-octenyl alanine
  MOD_RES (15)..(15): S-pentenyl alanine
  MOD_RES (18)..(18): Non-natural electrophile containing amino acid or absent
KTTAKLSXSAKRIQXELXEITLD

SEQ ID NO: 625 - protein, 20 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (12)..(12): S-pentenyl alanine
  MOD_RES (15)..(15): Non-natural electrophile containing amino acid or absent
XHGRXYLLLHRXFCXLKENN

SEQ ID NO: 626 - protein, 25 aa, Artificial Sequence
  source: /note="Description of Artificial Sequence: Synthetic peptide"
  MOD_RES (1)..(1): Norleucine
  MOD_RES (10)..(10): R-octenyl alanine
  MOD_RES (16)..(16): Norleucine
  MOD_RES (17)..(17): S-pentenyl alanine
  MOD_RES (20)..(20): Non-natural electrophile containing amino acid or absent
XETRYNLKSXAVKRLXXEAXELKDP

SEQ ID NO: 627 - protein, 27 aa, Artificial Sequence
  source: /note="Description of Artificial Sequence: Synthetic peptide"
  MOD_RES (1)..(1): Norleucine
  MOD_RES (12)..(12): R-octenyl alanine
  MOD_RES (19)..(19): S-pentenyl alanine
  MOD_RES (22)..(22): Non-natural electrophile containing amino acid or absent
XSSTSSKRAPTXATQRLKXDYXRIKKD

SEQ ID NO: 628 - protein, 18 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (10)..(10): S-pentenyl alanine
  MOD_RES (13)..(13): Non-natural electrophile containing amino acid or absent
XAXLPRRIIXETXRLLAE

SEQ ID NO: 629 - protein, 18 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (10)..(10): S-pentenyl alanine
  MOD_RES (13)..(13): Non-natural electrophile containing amino acid or absent
XAXLPHRIIXETXRLLAE

SEQ ID NO: 630 - protein, 17 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (9)..(9): S-pentenyl alanine
  MOD_RES (12)..(12): Non-natural electrophile containing amino acid or absent
  MOD_RES (13)..(13): Norleucine
XXRASRLKXELXXLATE

SEQ ID NO: 631 - protein, 27 aa, Artificial Sequence
  source: /note="Description of Artificial Sequence: Synthetic peptide"
  MOD_RES (1)..(1): Norleucine
  MOD_RES (12)..(12): R-octenyl alanine
  MOD_RES (19)..(19): S-pentenyl alanine
  MOD_RES (22)..(22): Non-natural electrophile containing amino acid or absent
XAATTGSGVKVXRNFRLLXELXEGQKG

SEQ ID NO: 632 - protein, 25 aa, Artificial Sequence
  source: /note="Description of Artificial Sequence: Synthetic peptide"
  MOD_RES (1)..(1): Norleucine
  MOD_RES (10)..(10): R-octenyl alanine
  MOD_RES (17)..(17): S-pentenyl alanine
  MOD_RES (20)..(20): Non-natural electrophile containing amino acid or absent
XAVSTGVKVXRNFRLLXELXEGQKG

SEQ ID NO: 633 - protein, 26 aa, Artificial Sequence
  source: /note="Description of Artificial Sequence: Synthetic peptide"
  MOD_RES (1)..(1): Norleucine
  MOD_RES (11)..(11): R-octenyl alanine
  MOD_RES (18)..(18): S-pentenyl alanine
  MOD_RES (21)..(21): Non-natural electrophile containing amino acid or absent
XNSNVENLPPXIIRLVYXEVXTLTAD

SEQ ID NO: 634 - protein, 19 aa, Artificial Sequence
  source: /note="Description of Artificial Sequence: Synthetic peptide"
  MOD_RES (4)..(4): R-octenyl alanine
  MOD_RES (11)..(11): S-pentenyl alanine
  MOD_RES (14)..(14): Non-natural electrophile containing amino acid or absent
  MOD_RES (17)..(17): Norleucine
  MOD_RES (18)..(18): Norleucine
ARGXVGKRLQXELXTLXXS

SEQ ID NO: 635 - protein, 18 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (4)..(4): Norleucine
  MOD_RES (10)..(10): S-pentenyl alanine
  MOD_RES (13)..(13): Non-natural electrophile containing amino acid or absent
XAXXQKRLQXELXALQND

SEQ ID NO: 636 - protein, 18 aa, Artificial Sequence
  source: /note="Description of Artificial Sequence: Synthetic peptide"
  MOD_RES (3)..(3): R-octenyl alanine
  MOD_RES (10)..(10): S-pentenyl alanine
  MOD_RES (12)..(12): Norleucine
  MOD_RES (13)..(13): Non-natural electrophile containing amino acid or absent
AKXFFSTVRXEXXLLATS

SEQ ID NO: 637 - protein, 23 aa, Artificial Sequence
  source: /note="Description of Artificial Sequence: Synthetic peptide"
  MOD_RES (8)..(8): R-octenyl alanine
  MOD_RES (15)..(15): S-pentenyl alanine
  MOD_RES (18)..(18): Non-natural electrophile containing amino acid or absent
ANDANSAXRARRLAXEAXTLSTS

SEQ ID NO: 638 - protein, 17 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (8)..(8): Norleucine
  MOD_RES (9)..(9): S-pentenyl alanine
  MOD_RES (12)..(12): Non-natural electrophile containing amino acid or absent
XXASRRLXXELXEIRKC

SEQ ID NO: 639 - protein, 17 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (5)..(5): Norleucine
  MOD_RES (9)..(9): S-pentenyl alanine
  MOD_RES (12)..(12): Non-natural electrophile containing amino acid or absent
XXASXRVVXELXDLQKK

SEQ ID NO: 640 - protein, 19 aa, Artificial Sequence
  source: /note="Description of Artificial Sequence: Synthetic peptide"
  MOD_RES (4)..(4): R-octenyl alanine
  MOD_RES (11)..(11): S-pentenyl alanine
  MOD_RES (14)..(14): Non-natural electrophile containing amino acid or absent
GPFXLEYSLLXEFXLVVKQ

SEQ ID NO: 641 - protein, 23 aa, Artificial Sequence
  source: /note="Description of Artificial Sequence: Synthetic peptide"
  MOD_RES (8)..(8): R-octenyl alanine
  MOD_RES (14)..(14): Norleucine
  MOD_RES (15)..(15): S-pentenyl alanine
  MOD_RES (18)..(18): Non-natural electrophile containing amino acid or absent
GAVSGSVXATDRLXXELXDIYRS

SEQ ID NO: 642 - protein, 23 aa, Artificial Sequence
  source: /note="Description of Artificial Sequence: Synthetic peptide"
  MOD_RES (8)..(8): R-octenyl alanine
  MOD_RES (14)..(14): Norleucine
  MOD_RES (15)..(15): S-pentenyl alanine
  MOD_RES (18)..(18): Non-natural electrophile containing amino acid or absent
GAVSGSVXASDRLXXELXDIYRS

SEQ ID NO: 643 - protein, 21 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (11)..(11): Norleucine
  MOD_RES (13)..(13): S-pentenyl alanine
  MOD_RES (16)..(16): Non-natural electrophile containing amino acid or absent
XSSPSXGKRRXDXDVXKLIES

SEQ ID NO: 644 - protein, 17 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (10)..(10): Norleucine
  MOD_RES (11)..(11): S-pentenyl alanine
  MOD_RES (14)..(14): Non-natural electrophile containing amino acid or absent
XSTXARRRLXXDFXRLQ

SEQ ID NO: 645 - protein, 14 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (10)..(10): Norleucine
  MOD_RES (11)..(11): S-pentenyl alanine
  MOD_RES (14)..(14): Non-natural electrophile containing amino acid or absent
XAGXALKRLXXEYX

SEQ ID NO: 646 - protein, 16 aa, Artificial Sequence
  source: /note="Description of Artificial Sequence: Synthetic peptide"
  MOD_RES (1)..(1): R-octenyl alanine
  MOD_RES (8)..(8): S-pentenyl alanine
  MOD_RES (11)..(11): Non-natural electrophile containing amino acid or absent
XALKRINXELXDLGKD

SEQ ID NO: 647 - protein, 20 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (12)..(12): S-pentenyl alanine
  MOD_RES (15)..(15): Non-natural electrophile containing amino acid or absent
XPSSXSEQLLRXQLXEIQKN

SEQ ID NO: 648 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (11)..(11): Diamino butanoic acid terminating in acrylamide or diamino butanoic acid terminating in bromoacetyl
  MOD_RES (13)..(13): S-pentenyl alanine
XANIAXVQRIXRXFKEVLKS

SEQ ID NO: 649 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (11)..(11): Diamino butanoic acid terminating in acrylamide or diamino butanoic acid terminating in bromoacetyl
  MOD_RES (13)..(13): S-pentenyl alanine
XSTPAXRRRLXRXFKRLQED

SEQ ID NO: 650 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (11)..(11): Diamino butanoic acid terminating in acrylamide or diamino butanoic acid terminating in bromoacetyl
  MOD_RES (13)..(13): S-pentenyl alanine
XTELQXALLLXRXLAELNKN

SEQ ID NO: 651 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Diamino butanoic acid terminating in acrylamide or diamino butanoic acid terminating in bromoacetyl
  MOD_RES (12)..(12): S-pentenyl alanine
XAGTXLKRLXAXYKQLTLN

SEQ ID NO: 652 - protein, 23 aa, Artificial Sequence
  source: /note="Description of Artificial Sequence: Synthetic peptide"
  MOD_RES (1)..(1): Norleucine
  MOD_RES (9)..(9): R-octenyl alanine
  MOD_RES (14)..(14): Diamino butanoic acid terminating in acrylamide or diamino butanoic acid terminating in bromoacetyl
  MOD_RES (16)..(16): S-pentenyl alanine
XARPLVPSXQKALXLXLKGLQEE

SEQ ID NO: 653 - protein, 23 aa, Artificial Sequence
  source: /note="Description of Artificial Sequence: Synthetic peptide"
  MOD_RES (1)..(1): Norleucine
  MOD_RES (6)..(6): Norleucine
  MOD_RES (9)..(9): R-octenyl alanine
  MOD_RES (14)..(14): Diamino butanoic acid terminating in acrylamide or diamino butanoic acid terminating in bromoacetyl
  MOD_RES (16)..(16): S-pentenyl alanine
XAQQQXTSXQKALXLXLKSLQEE

SEQ ID NO: 654 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (7)..(7): Diamino butanoic acid terminating in acrylamide or diamino butanoic acid terminating in bromoacetyl
  MOD_RES (9)..(9): S-pentenyl alanine
XXLKRIXKXLSDLQRD

SEQ ID NO: 655 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (7)..(7): Diamino butanoic acid terminating in acrylamide or diamino butanoic acid terminating in bromoacetyl
  MOD_RES (9)..(9): S-pentenyl alanine
XXLKRIXKXLNDLARD

SEQ ID NO: 656 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (7)..(7): Diamino butanoic acid terminating in acrylamide or diamino butanoic acid terminating in bromoacetyl
  MOD_RES (9)..(9): S-pentenyl alanine
XXLKRIXKXLSDLARD

SEQ ID NO: 657 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (7)..(7): Diamino butanoic acid terminating in acrylamide or diamino butanoic acid terminating in bromoacetyl
  MOD_RES (9)..(9): S-pentenyl alanine
XXLKRIXKXLTDLQRD

SEQ ID NO: 658 - protein, 23 aa, Artificial Sequence
  source: /note="Description of Artificial Sequence: Synthetic peptide"
  MOD_RES (9)..(9): R-octenyl alanine
  MOD_RES (14)..(14): Diamino butanoic acid terminating in acrylamide or diamino butanoic acid terminating in bromoacetyl
  MOD_RES (16)..(16): S-pentenyl alanine
KNSKLLSTXAKRIXKXLADITLD

SEQ ID NO: 659 - protein, 23 aa, Artificial Sequence
  source: /note="Description of Artificial Sequence: Synthetic peptide"
  MOD_RES (9)..(9): R-octenyl alanine
  MOD_RES (14)..(14): Diamino butanoic acid terminating in acrylamide or diamino butanoic acid terminating in bromoacetyl
  MOD_RES (16)..(16): S-pentenyl alanine
KTAAKLSTXAKRIXKXLAEITLD

SEQ ID NO: 660 - protein, 23 aa, Artificial Sequence
  source: /note="Description of Artificial Sequence: Synthetic peptide"
  MOD_RES (9)..(9): R-octenyl alanine
  MOD_RES (14)..(14): Diamino butanoic acid terminating in acrylamide or diamino butanoic acid terminating in bromoacetyl
  MOD_RES (16)..(16): S-pentenyl alanine
KTTAKLSTXAKRIXKXLAEITLD

SEQ ID NO: 661 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (11)..(11): Diamino butanoic acid terminating in acrylamide or diamino butanoic acid terminating in bromoacetyl
  MOD_RES (13)..(13): S-pentenyl alanine
XHGRAXLLLHXDXCDLKENN

SEQ ID NO: 662 - protein, 25 aa, Artificial Sequence
  source: /note="Description of Artificial Sequence: Synthetic peptide"
  MOD_RES (1)..(1): Norleucine
  MOD_RES (11)..(11): R-octenyl alanine
  MOD_RES (16)..(16): Diamino butanoic acid terminating in acrylamide or diamino butanoic acid terminating in bromoacetyl
  MOD_RES (18)..(18): S-pentenyl alanine
XETRYNLKSPXVKRLXKXAAELKDP

SEQ ID NO: 663 - protein, 27 aa, Artificial Sequence
  source: /note="Description of Artificial Sequence: Synthetic peptide"
  MOD_RES (1)..(1): Norleucine
  MOD_RES (13)..(13): R-octenyl alanine
  MOD_RES (18)..(18): Diamino butanoic acid terminating in acrylamide or diamino butanoic acid terminating in bromoacetyl
  MOD_RES (20)..(20): S-pentenyl alanine
XSSTSSKRAPTTXTQRLXQXYLRIKKD

SEQ ID NO: 664 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (9)..(9): Diamino butanoic acid terminating in acrylamide or diamino butanoic acid terminating in bromoacetyl
  MOD_RES (11)..(11): S-pentenyl alanine
XAGXPRRIXKXTQRLLAE

SEQ ID NO: 665 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (9)..(9): Diamino butanoic acid terminating in acrylamide or diamino butanoic acid terminating in bromoacetyl
  MOD_RES (11)..(11): S-pentenyl alanine
XAEXPHRIXKXTQRLLAE

SEQ ID NO: 666 - protein, 17 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (8)..(8): Diamino butanoic acid terminating in acrylamide or diamino butanoic acid terminating in bromoacetyl
  MOD_RES (10)..(10): S-pentenyl alanine
  MOD_RES (13)..(13): Norleucine
XQXASRLXRXLHXLATE

SEQ ID NO: 667 - protein, 27 aa, Artificial Sequence
  source: /note="Description of Artificial Sequence: Synthetic peptide"
  MOD_RES (1)..(1): Norleucine
  MOD_RES (13)..(13): R-octenyl alanine
  MOD_RES (18)..(18): Diamino butanoic acid terminating in acrylamide or diamino butanoic acid terminating in bromoacetyl
  MOD_RES (20)..(20): S-pentenyl alanine
XAATTGSGVKVPXNFRLXEXLEEGQKG

SEQ ID NO: 668 - protein, 25 aa, Artificial Sequence
  source: /note="Description of Artificial Sequence: Synthetic peptide"
  MOD_RES (1)..(1): Norleucine
  MOD_RES (11)..(11): R-octenyl alanine
  MOD_RES (16)..(16): Diamino butanoic acid terminating in acrylamide or diamino butanoic acid terminating in bromoacetyl
  MOD_RES (18)..(18): S-pentenyl alanine
XAVSTGVKVPXNFRLXEXLEEGQKG

SEQ ID NO: 669 - protein, 26 aa, Artificial Sequence
  source: /note="Description of Artificial Sequence: Synthetic peptide"
  MOD_RES (1)..(1): Norleucine
  MOD_RES (12)..(12): R-octenyl alanine
  MOD_RES (17)..(17): Diamino butanoic acid terminating in acrylamide or diamino butanoic acid terminating in bromoacetyl
  MOD_RES (19)..(19): S-pentenyl alanine
XNSNVENLPPHXIRLVXKXVTTLTAD

SEQ ID NO: 670 - protein, 19 aa, Artificial Sequence
  source: /note="Description of Artificial Sequence: Synthetic peptide"
  MOD_RES (5)..(5): R-octenyl alanine
  MOD_RES (10)..(10): Diamino butanoic acid terminating in acrylamide or diamino butanoic acid terminating in bromoacetyl
  MOD_RES (12)..(12): S-pentenyl alanine
  MOD_RES (14)..(14): Norleucine
  MOD_RES (17)..(17): Norleucine
  MOD_RES (18)..(18): Norleucine
ARGPXGKRLXQXLXTLXXS

SEQ ID NO: 671 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (9)..(9): Diamino butanoic acid terminating in acrylamide or diamino butanoic acid terminating in bromoacetyl
  MOD_RES (11)..(11): S-pentenyl alanine
XASXQKRLXKXLLALQND

SEQ ID NO: 672 - protein, 18 aa, Artificial Sequence
  source: /note="Description of Artificial Sequence: Synthetic peptide"
  MOD_RES (4)..(4): R-octenyl alanine
  MOD_RES (9)..(9): Diamino butanoic acid terminating in acrylamide or diamino butanoic acid terminating in bromoacetyl
  MOD_RES (11)..(11): S-pentenyl alanine
  MOD_RES (12)..(12): Norleucine
AKKXFSTVXKXXALLATS

SEQ ID NO: 673 - protein, 23 aa, Artificial Sequence
  source: /note="Description of Artificial Sequence: Synthetic peptide"
  MOD_RES (9)..(9): R-octenyl alanine
  MOD_RES (14)..(14): Diamino butanoic acid terminating in acrylamide or diamino butanoic acid terminating in bromoacetyl
  MOD_RES (16)..(16): S-pentenyl alanine
ANDANSAAXARRLXQXAVTLSTS

SEQ ID NO: 674 - protein, 17 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (8)..(8): Diamino butanoic acid terminating in acrylamide or diamino butanoic acid terminating in bromoacetyl
  MOD_RES (10)..(10): S-pentenyl alanine
XAXSRRLXKXLEEIRKC

SEQ ID NO: 675 - protein, 17 aa, Artificial Sequence
  source: /note="Description of Artificial Sequence: Synthetic peptide"
  MOD_RES (1)..(1): Norleucine
  MOD_RES (2)..(2): Norleucine
  MOD_RES (3)..(3): R-octenyl alanine
  MOD_RES (5)..(5): Norleucine
  MOD_RES (8)..(8): Diamino butanoic acid terminating in acrylamide or diamino butanoic acid terminating in bromoacetyl
  MOD_RES (10)..(10): S-pentenyl alanine
XXXSXRVXKXLEDLQKK

SEQ ID NO: 676 - protein, 19 aa, Artificial Sequence
  source: /note="Description of Artificial Sequence: Synthetic peptide"
  MOD_RES (5)..(5): R-octenyl alanine
  MOD_RES (10)..(10): Diamino butanoic acid terminating in acrylamide or diamino butanoic acid terminating in bromoacetyl
  MOD_RES (12)..(12): S-pentenyl alanine
GPFYXEYSLXAXFTLVVKQ

SEQ ID NO: 677 - protein, 23 aa, Artificial Sequence
  source: /note="Description of Artificial Sequence: Synthetic peptide"
  MOD_RES (9)..(9): R-octenyl alanine
  MOD_RES (14)..(14): Diamino butanoic acid terminating in acrylamide or diamino butanoic acid terminating in bromoacetyl
  MOD_RES (16)..(16): S-pentenyl alanine
GAVSGSVQXTDRLXKXLRDIYRS

SEQ ID NO: 678 - protein, 23 aa, Artificial Sequence
  source: /note="Description of Artificial Sequence: Synthetic peptide"
  MOD_RES (9)..(9): R-octenyl alanine
  MOD_RES (14)..(14): Diamino butanoic acid terminating in acrylamide or diamino butanoic acid terminating in bromoacetyl
  MOD_RES (16)..(16): S-pentenyl alanine
GAVSGSVQXSDRLXKXLRDIYRS

SEQ ID NO: 679 - protein, 21 aa, Artificial Sequence
  source: /note="Description of Artificial Sequence: Synthetic peptide"
  MOD_RES (1)..(1): Norleucine
  MOD_RES (7)..(7): R-octenyl alanine
  MOD_RES (11)..(11): Norleucine
  MOD_RES (12)..(12): Diamino butanoic acid terminating in acrylamide or diamino butanoic acid terminating in bromoacetyl
  MOD_RES (14)..(14): S-pentenyl alanine
XSSPSPXKRRXXTXVVKLIES

SEQ ID NO: 680 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine or R-octenyl alanine
  MOD_RES (10)..(10): Diamino butanoic acid terminating in acrylamide or diamino butanoic acid terminating in bromoacetyl
  MOD_RES (12)..(12): S-pentenyl alanine or R-octenyl alanine
  source: /note="See specification as filed for detailed description of substitutions and preferred embodiments"
XSTPXRRRLXRXFKRLQ

SEQ ID NO: 681 - protein, 14 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Diamino butanoic acid terminating in acrylamide or diamino butanoic acid terminating in bromoacetyl
  MOD_RES (12)..(12): S-pentenyl alanine
XAGTXLKRLXAXYK

SEQ ID NO: 682 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (7)..(7): Diamino butanoic acid terminating in acrylamide or diamino butanoic acid terminating in bromoacetyl
  MOD_RES (9)..(9): S-pentenyl alanine
XXLKRIXRXLADLGKD

SEQ ID NO: 683 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (11)..(11): Diamino butanoic acid terminating in acrylamide or diamino butanoic acid terminating in bromoacetyl
  MOD_RES (13)..(13): S-pentenyl alanine
XPSSAXEQLLXKXLKEIQKN

SEQ ID NO: 684 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (11)..(11): Diamino butanoic acid terminating in acrylamide or diamino butanoic acid terminating in bromoacetyl
  MOD_RES (12)..(12): S-pentenyl alanine
XANIXVQRIKXXFKEVLKS

SEQ ID NO: 685 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (11)..(11): Diamino butanoic acid terminating in acrylamide or diamino butanoic acid terminating in bromoacetyl
  MOD_RES (12)..(12): S-pentenyl alanine
XSTPXRRRLXXXFKRLQED

SEQ ID NO: 686 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (12)..(12): Diamino butanoic acid terminating in acrylamide or diamino butanoic acid terminating in bromoacetyl
  MOD_RES (13)..(13): S-pentenyl alanine
XTELQXALLLRXXLAELNKN

SEQ ID NO: 687 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (11)..(11): Diamino butanoic acid terminating in acrylamide or diamino butanoic acid terminating in bromoacetyl
  MOD_RES (12)..(12): S-pentenyl alanine
XAGTXLKRLXXXYKQLTLN

SEQ ID NO: 688 - protein, 23 aa, Artificial Sequence
  source: /note="Description of Artificial Sequence: Synthetic peptide"
  MOD_RES (1)..(1): Norleucine
  MOD_RES (9)..(9): R-octenyl alanine
  MOD_RES (15)..(15): Diamino butanoic acid terminating in acrylamide or diamino butanoic acid terminating in bromoacetyl
  MOD_RES (16)..(16): S-pentenyl alanine
XARPLVPSXQKALLXXLKGLQEE

SEQ ID NO: 689 - protein, 23 aa, Artificial Sequence
  source: /note="Description of Artificial Sequence: Synthetic peptide"
  MOD_RES (1)..(1): Norleucine
  MOD_RES (6)..(6): Norleucine
  MOD_RES (9)..(9): R-octenyl alanine
  MOD_RES (14)..(14): Norleucine
  MOD_RES (15)..(15): Diamino butanoic acid terminating in acrylamide or diamino butanoic acid terminating in bromoacetyl
  MOD_RES (16)..(16): S-pentenyl alanine
XAQQQXTSXQKALXXXLKSLQEE

SEQ ID NO: 690 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (8)..(8): Diamino butanoic acid terminating in acrylamide or diamino butanoic acid terminating in bromoacetyl
  MOD_RES (9)..(9): S-pentenyl alanine
XXLKRIQXXLSDLQRD

SEQ ID NO: 691 - protein, 16 aa, Artificial Sequence
  source: /note="Description of Artificial Sequence: Synthetic peptide"
  MOD_RES (1)..(1): Norleucine
  MOD_RES (2)..(2): S-pentenyl alanine or R-octenyl alanine
  MOD_RES (8)..(8): Diamino butanoic acid terminating in acrylamide or diamino butanoic acid terminating in bromoacetyl
  MOD_RES (9)..(9): S-pentenyl alanine or R-octenyl alanine
  source: /note="See specification as filed for detailed description of substitutions and preferred embodiments"
XXLKRIHXXLNDLARD

SEQ ID NO: 692 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (8)..(8): Diamino butanoic acid terminating in acrylamide or diamino butanoic acid terminating in bromoacetyl
  MOD_RES (9)..(9): S-pentenyl alanine
XXLKRINXXLSDLARD

SEQ ID NO: 693 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (8)..(8): Diamino butanoic acid terminating in acrylamide or diamino butanoic acid terminating in bromoacetyl
  MOD_RES (9)..(9): S-pentenyl alanine
XXLKRIQXXLTDLQRD

SEQ ID NO: 694 - protein, 23 aa, Artificial Sequence
  source: /note="Description of Artificial Sequence: Synthetic peptide"
  MOD_RES (9)..(9): R-octenyl alanine
  MOD_RES (15)..(15): Diamino butanoic acid terminating in acrylamide or diamino butanoic acid terminating in bromoacetyl
  MOD_RES (16)..(16): S-pentenyl alanine
KNSKLLSTXAKRIQXXLADITLD

SEQ ID NO: 695 - protein, 23 aa, Artificial Sequence
  source: /note="Description of Artificial Sequence: Synthetic peptide"
  MOD_RES (9)..(9): R-octenyl alanine
  MOD_RES (15)..(15): Diamino butanoic acid terminating in acrylamide or diamino butanoic acid terminating in bromoacetyl
  MOD_RES (16)..(16): S-pentenyl alanine
KTAAKLSTXAKRIQXXLAEITLD

SEQ ID NO: 696 - protein, 23 aa, Artificial Sequence
  source: /note="Description of Artificial Sequence: Synthetic peptide"
  MOD_RES (9)..(9): R-octenyl alanine
  MOD_RES (15)..(15): Diamino butanoic acid terminating in acrylamide or diamino butanoic acid terminating in bromoacetyl
  MOD_RES (16)..(16): S-pentenyl alanine
KTTAKLSTXAKRIQXXLAEITLD

SEQ ID NO: 697 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (12)..(12): Diamino butanoic acid terminating in acrylamide or diamino butanoic acid terminating in bromoacetyl
  MOD_RES (13)..(13): S-pentenyl alanine
XHGRAXLLLHRXXCDLKENN

SEQ ID NO: 698 - protein, 25 aa, Artificial Sequence
  source: /note="Description of Artificial Sequence: Synthetic peptide"
  MOD_RES (1)..(1): Norleucine
  MOD_RES (11)..(11): R-octenyl alanine
  MOD_RES (16)..(16): Norleucine
  MOD_RES (17)..(17): Diamino butanoic acid terminating in acrylamide or diamino butanoic acid terminating in bromoacetyl
  MOD_RES (18)..(18): S-pentenyl alanine
XETRYNLKSPXVKRLXXXAAELKDP

SEQ ID NO: 699 - protein, 27 aa, Artificial Sequence
  source: /note="Description of Artificial Sequence: Synthetic peptide"
  MOD_RES (1)..(1): Norleucine
  MOD_RES (13)..(13): R-octenyl alanine
  MOD_RES (19)..(19): Diamino butanoic acid terminating in acrylamide or diamino butanoic acid terminating in bromoacetyl
  MOD_RES (20)..(20): S-pentenyl alanine
XSSTSSKRAPTTXTQRLKXXYLRIKKD

SEQ ID NO: 700 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (10)..(10): Diamino butanoic acid terminating in acrylamide or diamino butanoic acid terminating in bromoacetyl
  MOD_RES (11)..(11): S-pentenyl alanine
XAGXPRRIIXXTQRLLAE

SEQ ID NO: 701 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (10)..(10): Diamino butanoic acid terminating in acrylamide or diamino butanoic acid terminating in bromoacetyl
  MOD_RES (11)..(11): S-pentenyl alanine
XAEXPHRIIXXTQRLLAE

SEQ ID NO: 702 - protein, 17 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (9)..(9): Diamino butanoic acid terminating in acrylamide or diamino butanoic acid terminating in bromoacetyl
  MOD_RES (10)..(10): S-pentenyl alanine
  MOD_RES (13)..(13): Norleucine
XQXASRLKXXLHXLATE

SEQ ID NO: 703 - protein, 27 aa, Artificial Sequence
  source: /note="Description of Artificial Sequence: Synthetic peptide"
  MOD_RES (1)..(1): Norleucine
  MOD_RES (13)..(13): R-octenyl alanine
  MOD_RES (19)..(19): Diamino butanoic acid terminating in acrylamide or diamino butanoic acid terminating in bromoacetyl
  MOD_RES (20)..(20): S-pentenyl alanine
XAATTGSGVKVPXNFRLLXXLEEGQKG

SEQ ID NO: 704 - protein, 25 aa, Artificial Sequence
  source: /note="Description of Artificial Sequence: Synthetic peptide"
  MOD_RES (1)..(1): Norleucine
  MOD_RES (11)..(11): R-octenyl alanine
  MOD_RES (17)..(17): Diamino butanoic acid terminating in acrylamide or diamino butanoic acid terminating in bromoacetyl
  MOD_RES (18)..(18): S-pentenyl alanine
XAVSTGVKVPXNFRLLXXLEEGQKG

SEQ ID NO: 705 - protein, 26 aa, Artificial Sequence
  source: /note="Description of Artificial Sequence: Synthetic peptide"
  MOD_RES (1)..(1): Norleucine
  MOD_RES (12)..(12): R-octenyl alanine
  MOD_RES (18)..(18): Diamino butanoic acid terminating in acrylamide or diamino butanoic acid terminating in bromoacetyl
  MOD_RES (19)..(19): S-pentenyl alanine
XNSNVENLPPHXIRLVYXXVTTLTAD

SEQ ID NO: 706 - protein, 19 aa, Artificial Sequence
  source: /note="Description of Artificial Sequence: Synthetic peptide"
  MOD_RES (5)..(5): R-octenyl alanine
  MOD_RES (11)..(11): Diamino butanoic acid terminating in acrylamide or diamino butanoic acid terminating in bromoacetyl
  MOD_RES (12)..(12): S-pentenyl alanine
  MOD_RES (14)..(14): Norleucine
  MOD_RES (17)..(17): Norleucine
  MOD_RES (18)..(18): Norleucine
ARGPXGKRLQXXLXTLXXS

SEQ ID NO: 707 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (10)..(10): Diamino butanoic acid terminating in acrylamide or diamino butanoic acid terminating in bromoacetyl
  MOD_RES (11)..(11): S-pentenyl alanine
XASXQKRLQXXLLALQND

SEQ ID NO: 708 - protein, 18 aa, Artificial Sequence
  source: /note="Description of Artificial Sequence: Synthetic peptide"
  MOD_RES (4)..(4): R-octenyl alanine
  MOD_RES (10)..(10): Diamino butanoic acid terminating in acrylamide or diamino butanoic acid terminating in bromoacetyl
  MOD_RES (11)..(11): S-pentenyl alanine
  MOD_RES (12)..(12): Norleucine
AKKXFSTVRXXXALLATS

SEQ ID NO: 709 - protein, 23 aa, Artificial Sequence
  source: /note="Description of Artificial Sequence: Synthetic peptide"
  MOD_RES (9)..(9): R-octenyl alanine
  MOD_RES (15)..(15): Diamino butanoic acid terminating in acrylamide or diamino butanoic acid terminating in bromoacetyl
  MOD_RES (16)..(16): S-pentenyl alanine
ANDANSAAXARRLAXXAVTLSTS

SEQ ID NO: 710 - protein, 17 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (8)..(8): Norleucine
  MOD_RES (9)..(9): Diamino butanoic acid terminating in acrylamide or diamino butanoic acid terminating in bromoacetyl
  MOD_RES (10)..(10): S-pentenyl alanine
XAXSRRLXXXLEEIRKC

SEQ ID NO: 711 - protein, 17 aa, Artificial Sequence
  source: /note="Description of Artificial Sequence: Synthetic peptide"
  MOD_RES (1)..(1): Norleucine
  MOD_RES (2)..(2): Norleucine
  MOD_RES (3)..(3): R-octenyl alanine
  MOD_RES (5)..(5): Norleucine
  MOD_RES (9)..(9): Diamino butanoic acid terminating in acrylamide or diamino butanoic acid terminating in bromoacetyl
  MOD_RES (10)..(10): S-pentenyl alanine
XXXSXRVVXXLEDLQKK

SEQ ID NO: 712 - protein, 19 aa, Artificial Sequence
  source: /note="Description of Artificial Sequence: Synthetic peptide"
  MOD_RES (5)..(5): R-octenyl alanine
  MOD_RES (11)..(11): Diamino butanoic acid terminating in acrylamide or diamino butanoic acid terminating in bromoacetyl
  MOD_RES (12)..(12): S-pentenyl alanine
GPFYXEYSLLXXFTLVVKQ

SEQ ID NO: 713 - protein, 23 aa, Artificial Sequence
  source: /note="Description of Artificial Sequence: Synthetic peptide"
  MOD_RES (9)..(9): R-octenyl alanine
  MOD_RES (14)..(14): Norleucine
  MOD_RES (15)..(15): Diamino butanoic acid terminating in acrylamide or diamino butanoic acid terminating in bromoacetyl
  MOD_RES (16)..(16): S-pentenyl alanine
GAVSGSVQXTDRLXXXLRDIYRS

SEQ ID NO: 714 - protein, 23 aa, Artificial Sequence
  source: /note="Description of Artificial Sequence: Synthetic peptide"
  MOD_RES (9)..(9): R-octenyl alanine
  MOD_RES (14)..(14): Norleucine
  MOD_RES (15)..(15): Diamino butanoic acid terminating in acrylamide or diamino butanoic acid terminating in bromoacetyl
  MOD_RES (16)..(16): S-pentenyl alanine
GAVSGSVQXSDRLXXXLRDIYRS

SEQ ID NO: 715 - protein, 21 aa, Artificial Sequence
  source: /note="Description of Artificial Sequence: Synthetic peptide"
  MOD_RES (1)..(1): Norleucine
  MOD_RES (7)..(7): R-octenyl alanine
  MOD_RES (11)..(11): Norleucine
  MOD_RES (13)..(13): Diamino butanoic acid terminating in acrylamide or diamino butanoic acid terminating in bromoacetyl
  MOD_RES (14)..(14): S-pentenyl alanine
XSSPSPXKRRXDXXVVKLIES

SEQ ID NO: 716 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (11)..(11): Diamino butanoic acid terminating in acrylamide or diamino butanoic acid terminating in bromoacetyl
  MOD_RES (12)..(12): S-pentenyl alanine
XSTPXRRRLXXXFKRLQ

SEQ ID NO: 717 - protein, 14 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (11)..(11): Diamino butanoic acid terminating in acrylamide or diamino butanoic acid terminating in bromoacetyl
  MOD_RES (12)..(12): S-pentenyl alanine
XAGTXLKRLXXXYK

SEQ ID NO: 718 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (8)..(8): Diamino butanoic acid terminating in acrylamide or diamino butanoic acid terminating in bromoacetyl
  MOD_RES (9)..(9): S-pentenyl alanine
XXLKRINXXLADLGKD

SEQ ID NO: 719 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (12)..(12): Diamino butanoic acid terminating in acrylamide or diamino butanoic acid terminating in bromoacetyl
  MOD_RES (13)..(13): S-pentenyl alanine
XPSSAXEQLLRXXLKEIQKN

SEQ ID NO: 720 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (12)..(12): S-pentenyl alanine
  MOD_RES (14)..(14): Diamino butanoic acid terminating in acrylamide or diamino butanoic acid terminating in bromoacetyl
XANIXVQRIKRXFXEVLKS

SEQ ID NO: 721 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
  MOD_RES (14)..(14): Diamino butanoic acid terminating in acrylamide or diamino butanoic acid terminating in bromoacetyl
XSTPXRRRLXRXFXRLQED

SEQ ID NO: 722 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (13)..(13): S-pentenyl alanine
  MOD_RES (15)..(15): Diamino butanoic acid terminating in acrylamide or diamino butanoic acid terminating in bromoacetyl
XTELQXALLLRRXLXELNKN

SEQ ID NO: 723 - protein, 19 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
  MOD_RES (14)..(14): Diamino butanoic acid terminating in acrylamide or diamino butanoic acid terminating in bromoacetyl
XAGTXLKRLXAXYXQLTLN

SEQ ID NO: 724 - protein, 23 aa, Artificial Sequence
  source: /note="Description of Artificial Sequence: Synthetic peptide"
  MOD_RES (1)..(1): Norleucine
  MOD_RES (9)..(9): R-octenyl alanine
  MOD_RES (16)..(16): S-pentenyl alanine
  MOD_RES (18)..(18): Diamino butanoic acid terminating in acrylamide or diamino butanoic acid terminating in bromoacetyl
XARPLVPSXQKALLLXLXGLQEE

SEQ ID NO: 725 - protein, 23 aa, Artificial Sequence
  source: /note="Description of Artificial Sequence: Synthetic peptide"
  MOD_RES (1)..(1): Norleucine
  MOD_RES (6)..(6): Norleucine
  MOD_RES (9)..(9): R-octenyl alanine
  MOD_RES (14)..(14): Norleucine
  MOD_RES (16)..(16): S-pentenyl alanine
  MOD_RES (18)..(18): Diamino butanoic acid terminating in acrylamide or diamino butanoic acid terminating in bromoacetyl
XAQQQXTSXQKALXLXLXSLQEE

SEQ ID NO: 726 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (9)..(9): S-pentenyl alanine
  MOD_RES (11)..(11): Diamino butanoic acid terminating in acrylamide or diamino butanoic acid terminating in bromoacetyl
XXLKRIQKXLXDLQRD

SEQ ID NO: 727 - protein, 16 aa, Artificial Sequence
  source: /note="Description of Artificial Sequence: Synthetic peptide"
  MOD_RES (1)..(1): Norleucine
  MOD_RES (2)..(2): S-pentenyl alanine or R-octenyl alanine
  MOD_RES (9)..(9): S-pentenyl alanine or R-octenyl alanine
  MOD_RES (11)..(11): Diamino butanoic acid terminating in acrylamide or diamino butanoic acid terminating in bromoacetyl
  source: /note="See specification as filed for detailed description of substitutions and preferred embodiments"
XXLKRIHKXLXDLARD

SEQ ID NO: 728 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (9)..(9): S-pentenyl alanine
  MOD_RES (11)..(11): Diamino butanoic acid terminating in acrylamide or diamino butanoic acid terminating in bromoacetyl
XXLKRINKXLXDLARD

SEQ ID NO: 729 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (9)..(9): S-pentenyl alanine
  MOD_RES (11)..(11): Diamino butanoic acid terminating in acrylamide or diamino butanoic acid terminating in bromoacetyl
XXLKRIQKXLXDLQRD

SEQ ID NO: 730 - protein, 23 aa, Artificial Sequence
  source: /note="Description of Artificial Sequence: Synthetic peptide"
  MOD_RES (9)..(9): R-octenyl alanine
  MOD_RES (16)..(16): S-pentenyl alanine
  MOD_RES (18)..(18): Diamino butanoic acid terminating in acrylamide or diamino butanoic acid terminating in bromoacetyl
KNSKLLSTXAKRIQKXLXDITLD

SEQ ID NO: 731 - protein, 23 aa, Artificial Sequence
  source: /note="Description of Artificial Sequence: Synthetic peptide"
  MOD_RES (9)..(9): R-octenyl alanine
  MOD_RES (16)..(16): S-pentenyl alanine
  MOD_RES (18)..(18): Diamino butanoic acid terminating in acrylamide or diamino butanoic acid terminating in bromoacetyl
KTAAKLSTXAKRIQKXLXEITLD

SEQ ID NO: 732 - protein, 23 aa, Artificial Sequence
  source: /note="Description of Artificial Sequence: Synthetic peptide"
  MOD_RES (9)..(9): R-octenyl alanine
  MOD_RES (16)..(16): S-pentenyl alanine
  MOD_RES (18)..(18): Diamino butanoic acid terminating in acrylamide or diamino butanoic acid terminating in bromoacetyl
KTTAKLSTXAKRIQKXLXEITLD

SEQ ID NO: 733 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (13)..(13): S-pentenyl alanine
  MOD_RES (15)..(15): Diamino butanoic acid terminating in acrylamide or diamino butanoic acid terminating in bromoacetyl
XHGRAXLLLHRDXCXLKENN

SEQ ID NO: 734 - protein, 25 aa, Artificial Sequence
  source: /note="Description of Artificial Sequence: Synthetic peptide"
  MOD_RES (1)..(1): Norleucine
  MOD_RES (11)..(11): R-octenyl alanine
  MOD_RES (16)..(16): Norleucine
  MOD_RES (18)..(18): S-pentenyl alanine
  MOD_RES (20)..(20): Diamino butanoic acid terminating in acrylamide or diamino butanoic acid terminating in bromoacetyl
XETRYNLKSPXVKRLXKXAXELKDP

SEQ ID NO: 735 - protein, 27 aa, Artificial Sequence
  source: /note="Description of Artificial Sequence: Synthetic peptide"
  MOD_RES (1)..(1): Norleucine
  MOD_RES (13)..(13): R-octenyl alanine
  MOD_RES (20)..(20): S-pentenyl alanine
  MOD_RES (22)..(22): Diamino butanoic acid terminating in acrylamide or diamino butanoic acid terminating in bromoacetyl
XSSTSSKRAPTTXTQRLKQXYXRIKKD

SEQ ID NO: 736 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (11)..(11): S-pentenyl alanine
  MOD_RES (13)..(13): Diamino butanoic acid terminating in acrylamide or diamino butanoic acid terminating in bromoacetyl
XAGXPRRIIKXTXRLLAE

SEQ ID NO: 737 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (11)..(11): S-pentenyl alanine
  MOD_RES (13)..(13): Diamino butanoic acid terminating in acrylamide or diamino butanoic acid terminating in bromoacetyl
XAEXPHRIIKXTXRLLAE

SEQ ID NO: 738 - protein, 17 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (10)..(10): S-pentenyl alanine
  MOD_RES (12)..(12): Diamino butanoic acid terminating in acrylamide or diamino butanoic acid terminating in bromoacetyl
  MOD_RES (13)..(13): Norleucine
XQXASRLKRXLXXLATE

SEQ ID NO: 739 - protein, 27 aa, Artificial Sequence
  source: /note="Description of Artificial Sequence: Synthetic peptide"
  MOD_RES (1)..(1): Norleucine
  MOD_RES (13)..(13): R-octenyl alanine
  MOD_RES (20)..(20): S-pentenyl alanine
  MOD_RES (22)..(22): Diamino butanoic acid terminating in acrylamide or diamino butanoic acid terminating in bromoacetyl
XAATTGSGVKVPXNFRLLEXLXEGQKG

SEQ ID NO: 740 - protein, 25 aa, Artificial Sequence
  source: /note="Description of Artificial Sequence: Synthetic peptide"
  MOD_RES (1)..(1): Norleucine
  MOD_RES (11)..(11): R-octenyl alanine
  MOD_RES (18)..(18): S-pentenyl alanine
  MOD_RES (20)..(20): Diamino butanoic acid terminating in acrylamide or diamino butanoic acid terminating in bromoacetyl
XAVSTGVKVPXNFRLLEXLXEGQKG

SEQ ID NO: 741 - protein, 26 aa, Artificial Sequence
  source: /note="Description of Artificial Sequence: Synthetic peptide"
  MOD_RES (1)..(1): Norleucine
  MOD_RES (12)..(12): R-octenyl alanine
  MOD_RES (19)..(19): S-pentenyl alanine
  MOD_RES (21)..(21): Diamino butanoic acid terminating in acrylamide or diamino butanoic acid terminating in bromoacetyl
XNSNVENLPPHXIRLVYKXVXTLTAD

SEQ ID NO: 742 - protein, 19 aa, Artificial Sequence
  source: /note="Description of Artificial Sequence: Synthetic peptide"
  MOD_RES (5)..(5): R-octenyl alanine
  MOD_RES (12)..(12): S-pentenyl alanine
  MOD_RES (14)..(14): Diamino butanoic acid terminating in acrylamide or diamino butanoic acid terminating in bromoacetyl
  MOD_RES (17)..(17): Norleucine
  MOD_RES (18)..(18): Norleucine
ARGPXGKRLQQXLXTLXXS

SEQ ID NO: 743 - protein, 18 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (11)..(11): S-pentenyl alanine
  MOD_RES (13)..(13): Diamino butanoic acid terminating in acrylamide or diamino butanoic acid terminating in bromoacetyl
XASXQKRLQKXLXALQND

SEQ ID NO: 744 - protein, 18 aa, Artificial Sequence
  source: /note="Description of Artificial Sequence: Synthetic peptide"
  MOD_RES (4)..(4): R-octenyl alanine
  MOD_RES (11)..(11): S-pentenyl alanine
  MOD_RES (12)..(12): Norleucine
  MOD_RES (13)..(13): Diamino butanoic acid terminating in acrylamide or diamino butanoic acid terminating in bromoacetyl
AKKXFSTVRKXXXLLATS

SEQ ID NO: 745 - protein, 23 aa, Artificial Sequence
  source: /note="Description of Artificial Sequence: Synthetic peptide"
  MOD_RES (9)..(9): R-octenyl alanine
  MOD_RES (16)..(16): S-pentenyl alanine
  MOD_RES (18)..(18): Diamino butanoic acid terminating in acrylamide or diamino butanoic acid terminating in bromoacetyl
ANDANSAAXARRLAQXAXTLSTS

SEQ ID NO: 746 - protein, 17 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (8)..(8): Norleucine
  MOD_RES (10)..(10): S-pentenyl alanine
  MOD_RES (12)..(12): Diamino butanoic acid terminating in acrylamide or diamino butanoic acid terminating in bromoacetyl
XAXSRRLXKXLXEIRKC

SEQ ID NO: 747 - protein, 17 aa, Artificial Sequence
  source: /note="Description of Artificial Sequence: Synthetic peptide"
  MOD_RES (1)..(1): Norleucine
  MOD_RES (2)..(2): Norleucine
  MOD_RES (3)..(3): R-octenyl alanine
  MOD_RES (5)..(5): Norleucine
  MOD_RES (10)..(10): S-pentenyl alanine
  MOD_RES (12)..(12): Diamino butanoic acid terminating in acrylamide or diamino butanoic acid terminating in bromoacetyl
XXXSXRVVKXLXDLQKK

SEQ ID NO: 748 - protein, 19 aa, Artificial Sequence
  source: /note="Description of Artificial Sequence: Synthetic peptide"
  MOD_RES (5)..(5): R-octenyl alanine
  MOD_RES (12)..(12): S-pentenyl alanine
  MOD_RES (14)..(14): Diamino butanoic acid terminating in acrylamide or diamino butanoic acid terminating in bromoacetyl
GPFYXEYSLLAXFXLVVKQ

SEQ ID NO: 749 - protein, 23 aa, Artificial Sequence
  source: /note="Description of Artificial Sequence: Synthetic peptide"
  MOD_RES (9)..(9): R-octenyl alanine
  MOD_RES (14)..(14): Norleucine
  MOD_RES (16)..(16): S-pentenyl alanine
  MOD_RES (18)..(18): Diamino butanoic acid terminating in acrylamide or diamino butanoic acid terminating in bromoacetyl
GAVSGSVQXTDRLXKXLXDIYRS

SEQ ID NO: 750 - protein, 23 aa, Artificial Sequence
  source: /note="Description of Artificial Sequence: Synthetic peptide"
  MOD_RES (9)..(9): R-octenyl alanine
  MOD_RES (14)..(14): Norleucine
  MOD_RES (16)..(16): S-pentenyl alanine
  MOD_RES (18)..(18): Diamino butanoic acid terminating in acrylamide or diamino butanoic acid terminating in bromoacetyl
GAVSGSVQXSDRLXKXLXDIYRS

SEQ ID NO: 751 - protein, 21 aa, Artificial Sequence
  source: /note="Description of Artificial Sequence: Synthetic peptide"
  MOD_RES (1)..(1): Norleucine
  MOD_RES (7)..(7): R-octenyl alanine
  MOD_RES (11)..(11): Norleucine
  MOD_RES (14)..(14): S-pentenyl alanine
  MOD_RES (16)..(16): Diamino butanoic acid terminating in acrylamide or diamino butanoic acid terminating in bromoacetyl
XSSPSPXKRRXDTXVXKLIES

SEQ ID NO: 752 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine or R-octenyl alanine
  MOD_RES (10)..(10): Norleucine
  MOD_RES (12)..(12): S-pentenyl alanine or R-octenyl alanine
  MOD_RES (14)..(14): Diamino butanoic acid terminating in acrylamide or diamino butanoic acid terminating in bromoacetyl
  source: /note="See specification as filed for detailed description of substitutions and preferred embodiments"
XSTPXRRRLXRXFXRLQ

SEQ ID NO: 753 - protein, 14 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
  MOD_RES (14)..(14): Diamino butanoic acid terminating in acrylamide or diamino butanoic acid terminating in bromoacetyl
XAGTXLKRLXAXYX

SEQ ID NO: 754 - protein, 16 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (9)..(9): S-pentenyl alanine
  MOD_RES (11)..(11): Diamino butanoic acid terminating in acrylamide or diamino butanoic acid terminating in bromoacetyl
XXLKRINRXLXDLGKD

SEQ ID NO: 755 - protein, 20 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (13)..(13): S-pentenyl alanine
  MOD_RES (15)..(15): Diamino butanoic acid terminating in acrylamide or diamino butanoic acid terminating in bromoacetyl
XPSSAXEQLLRKXLXEIQKN

SEQ ID NO: 756 - protein, 19 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (11)..(11): S-pentenyl alanine
  MOD_RES (14)..(14): Diamino butanoic acid terminating in acrylamide or diamino butanoic acid terminating in bromoacetyl
XANXAVQRIKXEFXEVLKS

SEQ ID NO: 757 - protein, 19 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (10)..(10): Norleucine
  MOD_RES (11)..(11): S-pentenyl alanine
  MOD_RES (14)..(14): Diamino butanoic acid terminating in acrylamide or diamino butanoic acid terminating in bromoacetyl
XSTXARRRLXXDFXRLQED

SEQ ID NO: 758 - protein, 20 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (12)..(12): S-pentenyl alanine
  MOD_RES (15)..(15): Diamino butanoic acid terminating in acrylamide or diamino butanoic acid terminating in bromoacetyl
XTELXSALLLRXQLXELNKN

SEQ ID NO: 759 - protein, 19 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (10)..(10): Norleucine
  MOD_RES (11)..(11): S-pentenyl alanine
  MOD_RES (14)..(14): Diamino butanoic acid terminating in acrylamide or diamino butanoic acid terminating in bromoacetyl
XAGXALKRLXXEYXQLTLN

SEQ ID NO: 760 - protein, 23 aa, Artificial Sequence
  source: /note="Description of Artificial Sequence: Synthetic peptide"
  MOD_RES (1)..(1): Norleucine
  MOD_RES (8)..(8): R-octenyl alanine
  MOD_RES (15)..(15): S-pentenyl alanine
  MOD_RES (18)..(18): Diamino butanoic acid terminating in acrylamide or diamino butanoic acid terminating in bromoacetyl
XARPLVPXSQKALLXELXGLQEE

SEQ ID NO: 761 - protein, 23 aa, Artificial Sequence
  source: /note="Description of Artificial Sequence: Synthetic peptide"
  MOD_RES (1)..(1): Norleucine
  MOD_RES (6)..(6): Norleucine
  MOD_RES (8)..(8): R-octenyl alanine
  MOD_RES (14)..(14): Norleucine
  MOD_RES (15)..(15): S-pentenyl alanine
  MOD_RES (18)..(18): Diamino butanoic acid terminating in acrylamide or diamino butanoic acid terminating in bromoacetyl
XAQQQXTXSQKALXXELXSLQEE

SEQ ID NO: 762 - protein, 16 aa, Artificial Sequence
  source: /note="Description of Artificial Sequence: Synthetic peptide"
  MOD_RES (1)..(1): R-octenyl alanine
  MOD_RES (8)..(8): S-pentenyl alanine
  MOD_RES (11)..(11): Diamino butanoic acid terminating in acrylamide or diamino butanoic acid terminating in bromoacetyl
XALKRIQXELXDLQRD

SEQ ID NO: 763 - protein, 16 aa, Artificial Sequence
  source: /note="Description of Artificial Sequence: Synthetic peptide"
  MOD_RES (1)..(1): S-pentenyl alanine or R-octenyl alanine
  MOD_RES (8)..(8): S-pentenyl alanine or R-octenyl alanine
  MOD_RES (11)..(11): Diamino butanoic acid terminating in acrylamide or diamino butanoic acid terminating in bromoacetyl
  source: /note="See specification as filed for detailed description of substitutions and preferred embodiments"
XALKRIHXELXDLARD

SEQ ID NO: 764 - protein, 16 aa, Artificial Sequence
  source: /note="Description of Artificial Sequence: Synthetic peptide"
  MOD_RES (1)..(1): R-octenyl alanine
  MOD_RES (8)..(8): S-pentenyl alanine
  MOD_RES (11)..(11): Diamino butanoic acid terminating in acrylamide or diamino butanoic acid terminating in bromoacetyl
XALKRINXELXDLARD

SEQ ID NO: 765 - protein, 16 aa, Artificial Sequence
  source: /note="Description of Artificial Sequence: Synthetic peptide"
  MOD_RES (1)..(1): R-octenyl alanine
  MOD_RES (8)..(8): S-pentenyl alanine
  MOD_RES (11)..(11): Diamino butanoic acid terminating in acrylamide or diamino butanoic acid terminating in bromoacetyl
XALKRIQXELXDLQRD

SEQ ID NO: 766 - protein, 23 aa, Artificial Sequence
  source: /note="Description of Artificial Sequence: Synthetic peptide"
  MOD_RES (8)..(8): R-octenyl alanine
  MOD_RES (15)..(15): S-pentenyl alanine
  MOD_RES (18)..(18): Diamino butanoic acid terminating in acrylamide or diamino butanoic acid terminating in bromoacetyl
KNSKLLSXSAKRIQXELXDITLD

SEQ ID NO: 767 - protein, 23 aa, Artificial Sequence
  source: /note="Description of Artificial Sequence: Synthetic peptide"
  MOD_RES (8)..(8): R-octenyl alanine
  MOD_RES (15)..(15): S-pentenyl alanine
  MOD_RES (18)..(18): Diamino butanoic acid terminating in acrylamide or diamino butanoic acid terminating in bromoacetyl
KTAAKLSXSAKRIQXELXEITLD

SEQ ID NO: 768 - protein, 23 aa, Artificial Sequence
  source: /note="Description of Artificial Sequence: Synthetic peptide"
  MOD_RES (8)..(8): R-octenyl alanine
  MOD_RES (15)..(15): S-pentenyl alanine
  MOD_RES (18)..(18): Diamino butanoic acid terminating in acrylamide or diamino butanoic acid terminating in bromoacetyl
KTTAKLSXSAKRIQXELXEITLD

SEQ ID NO: 769 - protein, 20 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (12)..(12): S-pentenyl alanine
  MOD_RES (15)..(15): Diamino butanoic acid terminating in acrylamide or diamino butanoic acid terminating in bromoacetyl
XHGRXYLLLHRXFCXLKENN

SEQ ID NO: 770 - protein, 25 aa, Artificial Sequence
  source: /note="Description of Artificial Sequence: Synthetic peptide"
  MOD_RES (1)..(1): Norleucine
  MOD_RES (10)..(10): R-octenyl alanine
  MOD_RES (16)..(16): Norleucine
  MOD_RES (17)..(17): S-pentenyl alanine
  MOD_RES (20)..(20): Diamino butanoic acid terminating in acrylamide or diamino butanoic acid terminating in bromoacetyl
XETRYNLKSXAVKRLXXEAXELKDP

SEQ ID NO: 771 - protein, 27 aa, Artificial Sequence
  source: /note="Description of Artificial Sequence: Synthetic peptide"
  MOD_RES (1)..(1): Norleucine
  MOD_RES (12)..(12): R-octenyl alanine
  MOD_RES (19)..(19): S-pentenyl alanine
  MOD_RES (22)..(22): Diamino butanoic acid terminating in acrylamide or diamino butanoic acid terminating in bromoacetyl
XSSTSSKRAPTXATQRLKXDYXRIKKD

SEQ ID NO: 772 - protein, 18 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (10)..(10): S-pentenyl alanine
  MOD_RES (13)..(13): Diamino butanoic acid terminating in acrylamide or diamino butanoic acid terminating in bromoacetyl
XAXLPRRIIXETXRLLAE

SEQ ID NO: 773 - protein, 18 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (10)..(10): S-pentenyl alanine
  MOD_RES (13)..(13): Diamino butanoic acid terminating in acrylamide or diamino butanoic acid terminating in bromoacetyl
XAXLPHRIIXETXRLLAE

SEQ ID NO: 774 - protein, 17 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (9)..(9): S-pentenyl alanine
  MOD_RES (12)..(12): Diamino butanoic acid terminating in acrylamide or diamino butanoic acid terminating in bromoacetyl
  MOD_RES (13)..(13): Norleucine
XXRASRLKXELXXLATE

SEQ ID NO: 775 - protein, 27 aa, Artificial Sequence
  source: /note="Description of Artificial Sequence: Synthetic peptide"
  MOD_RES (1)..(1): Norleucine
  MOD_RES (12)..(12): R-octenyl alanine
  MOD_RES (19)..(19): S-pentenyl alanine
  MOD_RES (22)..(22): Diamino butanoic acid terminating in acrylamide or diamino butanoic acid terminating in bromoacetyl
XAATTGSGVKVXRNFRLLXELXEGQKG

SEQ ID NO: 776 - protein, 25 aa, Artificial Sequence
  source: /note="Description of Artificial Sequence: Synthetic peptide"
  MOD_RES (1)..(1): Norleucine
  MOD_RES (10)..(10): R-octenyl alanine
  MOD_RES (17)..(17): S-pentenyl alanine
  MOD_RES (20)..(20): Diamino butanoic acid terminating in acrylamide or diamino butanoic acid terminating in bromoacetyl
XAVSTGVKVXRNFRLLXELXEGQKG

SEQ ID NO: 777 - protein, 26 aa, Artificial Sequence
  source: /note="Description of Artificial Sequence: Synthetic peptide"
  MOD_RES (1)..(1): Norleucine
  MOD_RES (11)..(11): R-octenyl alanine
  MOD_RES (18)..(18): S-pentenyl alanine
  MOD_RES (21)..(21): Diamino butanoic acid terminating in acrylamide or diamino butanoic acid terminating in bromoacetyl
XNSNVENLPPXIIRLVYXEVXTLTAD

SEQ ID NO: 778 - protein, 19 aa, Artificial Sequence
  source: /note="Description of Artificial Sequence: Synthetic peptide"
  MOD_RES (4)..(4): R-octenyl alanine
  MOD_RES (11)..(11): S-pentenyl alanine
  MOD_RES (14)..(14): Diamino butanoic acid terminating in acrylamide or diamino butanoic acid terminating in bromoacetyl
  MOD_RES (17)..(17): Norleucine
  MOD_RES (18)..(18): Norleucine
ARGXVGKRLQXELXTLXXS

SEQ ID NO: 779 - protein, 18 aa, Artificial Sequence
  source: /note="Description of Artificial Sequence: Synthetic peptide"
  MOD_RES (1)..(1): Norleucine
  MOD_RES (3)..(3): R-octenyl alanine
  MOD_RES (4)..(4): Norleucine
  MOD_RES (10)..(10): S-pentenyl alanine
  MOD_RES (13)..(13): Diamino butanoic acid terminating in acrylamide or diamino butanoic acid terminating in bromoacetyl
XAXXQKRLQXELXALQND

SEQ ID NO: 780 - protein, 18 aa, Artificial Sequence
  source: /note="Description of Artificial Sequence: Synthetic peptide"
  MOD_RES (3)..(3): R-octenyl alanine
  MOD_RES (10)..(10): S-pentenyl alanine
  MOD_RES (12)..(12): Norleucine
  MOD_RES (13)..(13): Diamino butanoic acid terminating in acrylamide or diamino butanoic acid terminating in bromoacetyl
AKXFFSTVRXEXXLLATS

SEQ ID NO: 781 - protein, 23 aa, Artificial Sequence
  source: /note="Description of Artificial Sequence: Synthetic peptide"
  MOD_RES (8)..(8): R-octenyl alanine
  MOD_RES (15)..(15): S-pentenyl alanine
  MOD_RES (18)..(18): Diamino butanoic acid terminating in acrylamide or diamino butanoic acid terminating in bromoacetyl
ANDANSAXRARRLAXEAXTLSTS

SEQ ID NO: 782 - protein, 17 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (8)..(8): Norleucine
  MOD_RES (9)..(9): S-pentenyl alanine
  MOD_RES (12)..(12): Diamino butanoic acid terminating in acrylamide or diamino butanoic acid terminating in bromoacetyl
XXASRRLXXELXEIRKC

SEQ ID NO: 783 - protein, 17 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (5)..(5): Norleucine
  MOD_RES (9)..(9): S-pentenyl alanine
  MOD_RES (12)..(12): Diamino butanoic acid terminating in acrylamide or diamino butanoic acid terminating in bromoacetyl
XXASXRVVXELXDLQKK

SEQ ID NO: 784 - protein, 19 aa, Artificial Sequence
  source: /note="Description of Artificial Sequence: Synthetic peptide"
  MOD_RES (4)..(4): R-octenyl alanine
  MOD_RES (11)..(11): S-pentenyl alanine
  MOD_RES (14)..(14): Diamino butanoic acid terminating in acrylamide or diamino butanoic acid terminating in bromoacetyl
GPFXLEYSLLXEFXLVVKQ

SEQ ID NO: 785 - protein, 23 aa, Artificial Sequence
  source: /note="Description of Artificial Sequence: Synthetic peptide"
  MOD_RES (8)..(8): R-octenyl alanine
  MOD_RES (14)..(14): Norleucine
  MOD_RES (15)..(15): S-pentenyl alanine
  MOD_RES (18)..(18): Diamino butanoic acid terminating in acrylamide or diamino butanoic acid terminating in bromoacetyl
GAVSGSVXATDRLXXELXDIYRS

SEQ ID NO: 786 - protein, 23 aa, Artificial Sequence
  source: /note="Description of Artificial Sequence: Synthetic peptide"
  MOD_RES (8)..(8): R-octenyl alanine
  MOD_RES (14)..(14): Norleucine
  MOD_RES (15)..(15): S-pentenyl alanine
  MOD_RES (18)..(18): Diamino butanoic acid terminating in acrylamide or diamino butanoic acid terminating in bromoacetyl
GAVSGSVXASDRLXXELXDIYRS

SEQ ID NO: 787 - protein, 21 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (11)..(11): Norleucine
  MOD_RES (13)..(13): S-pentenyl alanine
  MOD_RES (16)..(16): Diamino butanoic acid terminating in acrylamide or diamino butanoic acid terminating in bromoacetyl
XSSPSXGKRRXDXDVXKLIES

SEQ ID NO: 788 - protein, 17 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (10)..(10): Norleucine
  MOD_RES (11)..(11): S-pentenyl alanine
  MOD_RES (14)..(14): Diamino butanoic acid terminating in acrylamide or diamino butanoic acid terminating in bromoacetyl
XSTXARRRLXXDFXRLQ

SEQ ID NO: 789 - protein, 14 aa, Artificial Sequence
  source: /note="Description of Artificial Sequence: Synthetic peptide"
  MOD_RES (1)..(1): Norleucine
  MOD_RES (4)..(4): R-octenyl alanine
  MOD_RES (10)..(10): Norleucine
  MOD_RES (11)..(11): S-pentenyl alanine
  MOD_RES (14)..(14): Diamino butanoic acid terminating in acrylamide or diamino butanoic acid terminating in bromoacetyl
XAGXALKRLXXEYX

SEQ ID NO: 790 - protein, 16 aa, Artificial Sequence
  source: /note="Description of Artificial Sequence: Synthetic peptide"
  MOD_RES (1)..(1): R-octenyl alanine
  MOD_RES (8)..(8): S-pentenyl alanine
  MOD_RES (11)..(11): Diamino butanoic acid terminating in acrylamide or diamino butanoic acid terminating in bromoacetyl
XALKRINXELXDLGKD

SEQ ID NO: 791 - protein, 20 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (12)..(12): S-pentenyl alanine
  MOD_RES (15)..(15): Diamino butanoic acid terminating in acrylamide or diamino butanoic acid terminating in bromoacetyl
XPSSXSEQLLRXQLXEIQKN

SEQ ID NO: 792 - protein, 17 aa, Artificial Sequence
  source: /note="Description of Artificial Sequence: Synthetic peptide"
MSTPARRRLMRDFKELQ

SEQ ID NO: 793 - protein, 17 aa, Artificial Sequence
  source: /note="Description of Artificial Sequence: Synthetic peptide"
MATPARRRLMRDFKRLQ

SEQ ID NO: 794 - protein, 17 aa, Artificial Sequence
  source: /note="Description of Artificial Sequence: Synthetic peptide"
MSAPARRRLMRDFKRLQ

SEQ ID NO: 795 - protein, 17 aa, Artificial Sequence
  source: /note="Description of Artificial Sequence: Synthetic peptide"
MSTAARRRLMRDFKRLQ

SEQ ID NO: 796 - protein, 17 aa, Artificial Sequence
  source: /note="Description of Artificial Sequence: Synthetic peptide"
MSTPAARRLMRDFKRLQ

SEQ ID NO: 797 - protein, 17 aa, Artificial Sequence
  source: /note="Description of Artificial Sequence: Synthetic peptide"
MSTPARARLMRDFKRLQ

SEQ ID NO: 798 - protein, 17 aa, Artificial Sequence
  source: /note="Description of Artificial Sequence: Synthetic peptide"
MSTPARRALMRDFKRLQ

SEQ ID NO: 799 - protein, 17 aa, Artificial Sequence
  source: /note="Description of Artificial Sequence: Synthetic peptide"
MSTPARRRAMRDFKRLQ

SEQ ID NO: 800 - protein, 17 aa, Artificial Sequence
  source: /note="Description of Artificial Sequence: Synthetic peptide"
MSTPARRRLARDFKRLQ

SEQ ID NO: 801 - protein, 17 aa, Artificial Sequence
  source: /note="Description of Artificial Sequence: Synthetic peptide"
MSTPARRRLMADFKRLQ

SEQ ID NO: 802 - protein, 17 aa, Artificial Sequence
  source: /note="Description of Artificial Sequence: Synthetic peptide"
MSTPARRRLMRDAKRLQ

SEQ ID NO: 803 - protein, 17 aa, Artificial Sequence
  source: /note="Description of Artificial Sequence: Synthetic peptide"
MSTPARRRLMRDFARLQ

SEQ ID NO: 804 - protein, 17 aa, Artificial Sequence
  source: /note="Description of Artificial Sequence: Synthetic peptide"
MSTPARRRLMRDFKALQ

SEQ ID NO: 805 - protein, 17 aa, Artificial Sequence
  source: /note="Description of Artificial Sequence: Synthetic peptide"
MSTPARRRLMRDFKRAQ

SEQ ID NO: 806 - protein, 17 aa, Artificial Sequence
  source: /note="Description of Artificial Sequence: Synthetic peptide"
MSTPARRRLMRDFKRLA

SEQ ID NO: 807 - protein, 17 aa, Artificial Sequence
  source: /note="Description of Artificial Sequence: Synthetic peptide"
  MOD_RES (5)..(5): R-octenyl alanine
  MOD_RES (10)..(10): Norleucine
  MOD_RES (12)..(12): S-pentenyl alanine
ASTPXRRRLXRXFKRLQ

SEQ ID NO: 808 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRRRLXRXFRRLQ

SEQ ID NO: 809 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXERRLXRXFKRLQ

SEQ ID NO: 810 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRRELXRXFKRLQ

SEQ ID NO: 811 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRRRLXEXFKRLQ

SEQ ID NO: 812 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRRRLXRXFKELQ

SEQ ID NO: 813 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XATPXRRRLXRXFKRLQ

SEQ ID NO: 814 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSAPXRRRLXRXFKRLQ

SEQ ID NO: 815 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTAXRRRLXRXFKRLQ

SEQ ID NO: 816 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXARRLXRXFKRLQ

SEQ ID NO: 817 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRARLXRXFKRLQ

SEQ ID NO: 818 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRRALXRXFKRLQ

SEQ ID NO: 819 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRRRAXRXFKRLQ

SEQ ID NO: 820 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (12)..(12): S-pentenyl alanine
XSTPXRRRLARXFKRLQ

SEQ ID NO: 821 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRRRLXAXFKRLQ

SEQ ID NO: 822 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRRRLXRXAKRLQ

SEQ ID NO: 823 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRRRLXRXFARLQ

SEQ ID NO: 824 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRRRLXRXFKALQ

SEQ ID NO: 825 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRRRLXRXFKRAQ

SEQ ID NO: 826 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRRRLXRXFKRLA

SEQ ID NO: 827 - protein, 18 aa, Artificial Sequence
  source: /note="Description of Artificial Sequence: Synthetic peptide"
  MOD_RES (11)..(11): Non-natural electrophile containing amino acid or absent
MPSSASRQLLXKQLKEIQ

SEQ ID NO: 828 - protein, 18 aa, Artificial Sequence
  source: /note="Description of Artificial Sequence: Synthetic peptide"
  MOD_RES (12)..(12): Non-natural electrophile containing amino acid or absent
MPSSASRQLLRXQLKEIQ

SEQ ID NO: 829 - protein, 18 aa, Artificial Sequence
  source: /note="Description of Artificial Sequence: Synthetic peptide"
  MOD_RES (15)..(15): Non-natural electrophile containing amino acid or absent
MPSSASRQLLRKQLXEIQ

SEQ ID NO: 830 - protein, 18 aa, Artificial Sequence
  source: /note="Description of Artificial Sequence: Synthetic peptide"
  MOD_RES (11)..(11): Diamino butanoic acid terminating in acrylamide or diamino butanoic acid terminating in bromoacetyl
MPSSASRQLLXKQLKEIQ

SEQ ID NO: 831 - protein, 18 aa, Artificial Sequence
  source: /note="Description of Artificial Sequence: Synthetic peptide"
  MOD_RES (12)..(12): Diamino butanoic acid terminating in acrylamide or diamino butanoic acid terminating in bromoacetyl
MPSSASRQLLRXQLKEIQ

SEQ ID NO: 832 - protein, 18 aa, Artificial Sequence
  source: /note="Description of Artificial Sequence: Synthetic peptide"
  MOD_RES (15)..(15): Diamino butanoic acid terminating in acrylamide or diamino butanoic acid terminating in bromoacetyl
MPSSASRQLLRKQLXEIQ

SEQ ID NO: 833 - protein, 18 aa, Artificial Sequence
  source: /note="Description of Artificial Sequence: Synthetic peptide"
  MOD_RES (1)..(1): Norleucine
  MOD_RES (5)..(5): Any non-natural amino acid which can be covalently joined "stapled together") using a ring-closing metathesis (RCM) reaction to form a cross-linked ring
  MOD_RES (12)..(12): Any non-natural amino acid which can be covalently joined "stapled together") using a ring-closing metathesis (RCM) reaction to form a cross-linked ring
  MOD_RES (15)..(15): Non-natural electrophile containing amino acid or absent
XPSSXSRQLLRXQLXEIQ

SEQ ID NO: 834 - protein, 18 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (12)..(12): Non-natural electrophile containing amino acid or absent
  MOD_RES (13)..(13): Any non-natural amino acid which can be covalently joined "stapled together") using a ring-closing metathesis (RCM) reaction to form a cross-linked ring
XPSSAXRQLLRXXLKEIQ

SEQ ID NO: 835 - protein, 18 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (11)..(11): Non-natural electrophile containing amino acid or absent
  MOD_RES (13)..(13): Any non-natural amino acid which can be covalently joined "stapled together") using a ring-closing metathesis (RCM) reaction to form a cross-linked ring
XPSSAXRQLLXKXLKEIQ

SEQ ID NO: 836 - protein, 18 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (13)..(13): Any non-natural amino acid which can be covalently joined "stapled together") using a ring-closing metathesis (RCM) reaction to form a cross-linked ring
  MOD_RES (15)..(15): Non-natural electrophile containing amino acid or absent
XPSSAXRQLLRKXLXEIQ

SEQ ID NO: 837 - protein, 18 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (12)..(12): S-pentenyl alanine
  MOD_RES (15)..(15): Non-natural electrophile containing amino acid or absent
XPSSXSRQLLRXQLXEIQ

SEQ ID NO: 838 - protein, 18 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (12)..(12): Non-natural electrophile containing amino acid or absent
  MOD_RES (13)..(13): S-pentenyl alanine
XPSSAXRQLLRXXLKEIQ

SEQ ID NO: 839 - protein, 18 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (11)..(11): Non-natural electrophile containing amino acid or absent
  MOD_RES (13)..(13): S-pentenyl alanine
XPSSAXRQLLXKXLKEIQ

SEQ ID NO: 840 - protein, 18 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (13)..(13): S-pentenyl alanine
  MOD_RES (15)..(15): Non-natural electrophile containing amino acid or absent
XPSSAXRQLLRKXLXEIQ

SEQ ID NO: 841 - protein, 18 aa, Artificial Sequence
  source: /note="Description of Artificial Sequence: Synthetic peptide"
  MOD_RES (1)..(1): Norleucine
  MOD_RES (5)..(5): S-pentenyl alanine or R-octenyl alanine
  MOD_RES (12)..(12): S-pentenyl alanine or R-octenyl alanine
  MOD_RES (15)..(15): Diamino butanoic acid terminating in acrylamide or diamino butanoic acid terminating in bromoacetyl
  source: /note="See specification as filed for detailed description of substitutions and preferred embodiments"
XPSSXSRQLLRXQLXEIQ

SEQ ID NO: 842 - protein, 18 aa, Artificial Sequence
  source: /note="Description of Artificial Sequence: Synthetic peptide"
  MOD_RES (1)..(1): Norleucine
  MOD_RES (6)..(6): S-pentenyl alanine or R-octenyl alanine
  MOD_RES (12)..(12): Diamino butanoic acid terminating in acrylamide or diamino butanoic acid terminating in bromoacetyl
  MOD_RES (13)..(13): S-pentenyl alanine or R-octenyl alanine
  source: /note="See specification as filed for detailed description of substitutions and preferred embodiments"
XPSSAXRQLLRXXLKEIQ

SEQ ID NO: 843 - protein, 18 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (11)..(11): Diamino butanoic acid terminating in acrylamide or diamino butanoic acid terminating in bromoacetyl
  MOD_RES (13)..(13): S-pentenyl alanine
XPSSAXRQLLXKXLKEIQ

SEQ ID NO: 844 - protein, 18 aa, Artificial Sequence
  source: /note="Description of Artificial Sequence: Synthetic peptide"
  MOD_RES (1)..(1): Norleucine
  MOD_RES (6)..(6): S-pentenyl alanine or R-octenyl alanine
  MOD_RES (13)..(13): S-pentenyl alanine or R-octenyl alanine
  MOD_RES (15)..(15): Diamino butanoic acid terminating in acrylamide or diamino butanoic acid terminating in bromoacetyl
  source: /note="See specification as filed for detailed description of substitutions and preferred embodiments"
XPSSAXRQLLRKXLXEIQ

SEQ ID NO: 845 - protein, 1058 aa, Homo sapiens
MSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSQGVSMLYSFFMPAAKLKERLDQPMTEIVSRVSKRKLGRHVRALVLELCCNDESGEDVEVPYVRYTIR

SEQ ID NO: 846 - protein, 640 aa, Homo sapiens
MALSRGLPRELAEAVAGGRVLVVGAGGIGCELLKNLVLTGFSHIDLIDLDTIDVSNLNRQFLFQKKHVGRSKAQVAKESVLQFYPKANIVAYHDSIMNPDYNVEFFRQFILVMNALDNRAARNHVNRMCLAADVPLIESGTAGYLGQVTTIKKGVTECYECHPKPTQRTFPGCTIRNTPSEPIHCIVWAKYLFNQLFGEEDADQEVSPDRADPEAAWEPTEAEARARASNEDGDIKRISTKEWAKSTGYDPVKLFTKLFKDDIRYLLTMDKLWRKRKPPVPLDWAEVQSQGEETNASDQQNEPQLGLKDQQVLDVKSYARLFSKSIETLRVHLAEKGDGAELIWDKDDPSAMDFVTSAANLRMHIFSMNMKSRFDIKSMAGNIIPAIATTNAVIAGLIVLEGLKILSGKIDQCRTIFLNKQPNPRKKLLVPCALDPPNPNCYVCASKPEVTVRLNVHKVTVLTLQDKIVKEKFAMVAPDVQIEDGKGTILISSEEGETEANNHKKLSEFGIRNGSRLQADDFLQDYTLLINILHSEDLGKDVEFEVVGDAPEKVGPKQAEDAAKSITNGSDDGAQPSTSTAQEQDDVLIVDSDEEDSSNNADVSEEERSRKRKLDEKENLSAKRSRIEQKEELDDVIALD

SEQ ID NO: 847 - protein, 463 aa, Homo sapiens
MADGEEPEKKRRRIEELLAEKMAVDGGCGDTGDWEGRWNHVKKFLERSGPFTHPDFEPSTESLQFLLDTCKVLVIGAGGLGCELLKNLALSGFRQIHVIDMDTIDVSNLNRQFLFRPKDIGRPKAEVAAEFLNDRVPNCNVVPHFNKIQDFNDTFYRQFHIIVCGLDSIIARRWINGMLISLLNYEDGVLDPSSIVPLIDGGTEGFKGNARVILPGMTACIECTLELYPPQVNFPMCTIASMPRLPEHCIEYVRMLQWPKEQPFGEGVPLDGDDPEHIQWIFQKSLERASQYNIRGVTYRLTQGVVKRIIPAVASTNAVIAAVCATEVFKIATSAYIPLNNYLVFNDVDGLYTYTFEAERKENCPACSQLPQNIQFSPSAKLQEVLDYLTNSASLQMKSPAITATLEGKNRTLYLQSVTSIEERTRPNLSKTLKELGLVDGQELAVADVTTPQTVLFKLHFTS

SEQ ID NO: 848 - protein, 1052 aa, Homo sapiens
MEGSEPVAAHQGEEASCSSWGTGSTNKNLPIMSTASVEIDDALYSRQRYVLGDTAMQKMAKSHVFLSGMGGLGLEIAKNLVLAGIKAVTIHDTEKCQAWDLGTNFFLSEDDVVNKRNRAEAVLKHIAELNPYVHVTSSSVPFNETTDLSFLDKYQCVVLTEMKLPLQKKINDFCRSQCPPIKFISADVHGIWSRLFCDFGDEFEVLDTTGEEPKEIFISNITQANPGIVTCLENHPHKLETGQFLTFREINGMTGLNGSIQQITVISPFSFSIGDTTELEPYLHGGIAVQVKTPKTVFFESLERQLKHPKCLIVDFSNPEAPLEIHTAMLALDQFQEKYSRKPNVGCQQDSEELLKLATSISETLEEKPDVNADIVHWLSWTAQGFLSPLAAAVGGVASQEVLKAVTGKFSPLCQWLYLEAADIVESLGKPECEEFLPRGDRYDALRACIGDTLCQKLQNLNIFLVGCGAIGCEMLKNFALLGVGTSKEKGMITVTDPDLIEKSNLNRQFLFRPHHIQKPKSYTAADATLKINSQIKIDAHLNKVCPTTETIYNDEFYTKQDVIITALDNVEARRYVDSRCLANLRPLLDSGTMGTKGHTEVIVPHLTESYNSHRDPPEEEIPFCTLKSFPAAIEHTIQWARDKFESSFSHKPSLFNKFWQTYSSAEEVLQKIQSGHSLEGCFQVIKLLSRRPRNWSQCVELARLKFEKYFNHKALQLLHCFPLDIRLKDGSLFWQSPKRPPSPIKFDLNEPLHLSFLQNAAKLYATVYCIPFAEEDLSADALLNILSEVKIQEFKPSNKVVQTDETARKPDHVPISSEDERNAIFQLEKAILSNEATKSDLQMAVLSFEKDDDHNGHIDFITAASNLRAKMYSIEPADRFKTKRIAGKIIPAIATTTATVSGLVALEMIKVTGGYPFEAYKNCFLNLAIPIVVFTETTEVRKTKIRNGISFTIWDRWTVHGKEDFTLLDFINAVKEKYGIEPTMVVQGVKMLYVPVMPGHAKRLKLTMHKLVKPTTEKKYVDLTVSFAPDIDGDEDLPGPPVRYYFSHDTD

SEQ ID NO: 849 - protein, 1012 aa, Schizosaccharomyces pombe
MSNNMNIDQTDQNTIDEGLYSRQLYVLGHEAMKQMSQSNVLIIGCKGLGVEIAKNVCLAGVKSVTLYDPQPTRIEDLSSQYFLTEDDIGVPRAKVTVSKLAELNQYVPVSVVDELSTEYLKNFKCVVVTETSLTKQLEINDFTHKNHIAYIAADSRGLFGSIFCDFGENFICTDTDGNEPLTGMIASITDDGVVTMLEETRHGLENGDFVKFTEVKGMPGLNDGTPRKVEVKGPYTFSIGSVKDLGSAGYNGVFTQVKVPTKISFKSLRESLKDPEYVYPDFGKMMRPPQYHIAFQALSAFADAHEGSLPRPRNDIDAAEFFEFCKKIASTLQFDVELDEKLIKEISYQARGDLVAMSAFLGGAVAQEVLKATTSKFYPLKQYFYFDSLESLPSSVTISEETCKPRGCRYDGQIAVFGSEFQEKIASLSTFLVGAGAIGCEMLKNWAMMGVATGESGHISVTDMDSIEKSNLNRQFLFRPRDVGKLKSECASTAVSIMNPSLTGKITSYQERVGPESEGIFGDEFFEKLSLVTNALDNVEARMYVDRRCVFFEKPLLESGTLGTKGNTQVVVPHLTESYGSSQDPPEKSFPICTLKNFPNRIEHTIAWARDLFEGLFKQPIDNVNMYLSSPNFLETSLKTSSNPREVLENIRDYLVTEKPLSFEECIMWARLQFDKFFNNNIQQLLFNFPKDSVTSTGQPFWSGPKRAPTPLSFDIHNREHFDFIVAAASLYAFNYGLKSETDPAIYERVLAGYNPPPFAPKSGIKIQVNENEEAPETAANKDKQELKSIADSLPPPSSLVGFRLTPAEFEKDDDSNHHIDFITAASNLRAMNYDITPADRFKTKFVAGKIVPAMCTSTAVVSGLVCLELVKLVDGKKKIEEYKNGFFNLAIGLFTFSDPIASPKMKVNGKEIDKIWDRYNLPDCTLQELIDYFQKEEGLEVTMLSSGVSLLYANFQPPKKLAERLPLKISELVEQITKKKLEPFRKHLVLEICCDDANGEDVEVPFICIKL

SEQ ID NO: 850 - protein, 18 aa, Artificial Sequence
  source: /note="Description of Artificial Sequence: Synthetic peptide"
  MOD_RES (1)..(1): Norleucine
  MOD_RES (6)..(6): Any non-natural amino acid which can be covalently joined "stapled together") using a ring-closing metathesis (RCM) reaction to form a cross-linked ring
  MOD_RES (13)..(13): Any non-natural amino acid which can be covalently joined "stapled together") using a ring-closing metathesis (RCM) reaction to form a cross-linked ring
XPSSAXRQLLRKXLKEIQ

SEQ ID NO: 851 - protein, 18 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (13)..(13): S-pentenyl alanine
XPSSAXRQLLRKXLKEIQ

SEQ ID NO: 852 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XSTPXRERLXRXFKRLQ

SEQ ID NO: 853 - protein, 17 aa, Artificial Sequence
  source: /note="Description of Artificial Sequence: Synthetic peptide"
  MOD_RES (1)..(1): Norleucine
  MOD_RES (8)..(8): R-octenyl alanine
  MOD_RES (11)..(11): Norleucine
  MOD_RES (15)..(15): S-pentenyl alanine
XSSPSPGXRRXLRDXVK

SEQ ID NO: 854 - protein, 16 aa, Artificial Sequence
  source: /note="Description of Artificial Sequence: Synthetic peptide"
  MOD_RES (1)..(1): R-octenyl alanine
  MOD_RES (8)..(8): S-pentenyl alanine
XALKRIHXELNDLARD

SEQ ID NO: 855 - protein, 4 aa, Artificial Sequence
  source: /note="Description of Artificial Sequence: Synthetic peptide"
MANI

SEQ ID NO: 856 - protein, 6 aa, Artificial Sequence
  source: /note="Description of Artificial Sequence: Synthetic peptide"
VQRIKR

SEQ ID NO: 857 - protein, 7 aa, Artificial Sequence
  source: /note="Description of Artificial Sequence: Synthetic peptide"
FKEVLKS

SEQ ID NO: 858 - protein, 7 aa, Artificial Sequence
  source: /note="Description of Artificial Sequence: Synthetic peptide"
MANIAVQ

SEQ ID NO: 859 - protein, 4 aa, Artificial Sequence
  source: /note="Description of Artificial Sequence: Synthetic peptide"
IAVQ

SEQ ID NO: 860 - protein, 4 aa, Artificial Sequence
  source: /note="Description of Artificial Sequence: Synthetic peptide"
LNKN

SEQ ID NO: 861 - protein, 10 aa, Artificial Sequence
  source: /note="Description of Artificial Sequence: Synthetic peptide"
MANIAVQRIK

SEQ ID NO: 862 - protein, 7 aa, Artificial Sequence
  source: /note="Description of Artificial Sequence: Synthetic peptide"
IAVQRIK

SEQ ID NO: 863 - protein, 4 aa, Artificial Sequence
  source: /note="Description of Artificial Sequence: Synthetic peptide"
VLKS

SEQ ID NO: 864 - protein, 11 aa, Artificial Sequence
  source: /note="Description of Artificial Sequence: Synthetic peptide"
MANIAVQRIKR

SEQ ID NO: 865 - protein, 8 aa, Artificial Sequence
  source: /note="Description of Artificial Sequence: Synthetic peptide"
IAVQRIKR

SEQ ID NO: 866 - protein, 6 aa, Artificial Sequence
  source: /note="Description of Artificial Sequence: Synthetic peptide"
AVQRIK

SEQ ID NO: 867 - protein, 8 aa, Artificial Sequence
  source: /note="Description of Artificial Sequence: Synthetic peptide"
EFKEVLKS

SEQ ID NO: 868 - protein, 6 aa, Artificial Sequence
  source: /note="Description of Artificial Sequence: Synthetic peptide"
MANIAV

SEQ ID NO: 869 - protein, 6 aa, Artificial Sequence
  source: /note="Description of Artificial Sequence: Synthetic peptide"
RIKREF

SEQ ID NO: 870 - protein, 5 aa, Artificial Sequence
  source: /note="Description of Artificial Sequence: Synthetic peptide"
EVLKS

SEQ ID NO: 871 - protein, 4 aa, Artificial Sequence
  source: /note="Description of Artificial Sequence: Synthetic peptide"
MSTP

SEQ ID NO: 872 - protein, 6 aa, Artificial Sequence
  source: /note="Description of Artificial Sequence: Synthetic peptide"
RRRLMR

SEQ ID NO: 873 - protein, 7 aa, Artificial Sequence
  source: /note="Description of Artificial Sequence: Synthetic peptide"
FKRLQED

SEQ ID NO: 874 - protein, 7 aa, Artificial Sequence
  source: /note="Description of Artificial Sequence: Synthetic peptide"
MSTPARR

SEQ ID NO: 875 - protein, 4 aa, Artificial Sequence
  source: /note="Description of Artificial Sequence: Synthetic peptide"
PARR

SEQ ID NO: 876 - protein, 10 aa, Artificial Sequence
  source: /note="Description of Artificial Sequence: Synthetic peptide"
MSTPARRRLM

SEQ ID NO: 877 - protein, 7 aa, Artificial Sequence
  source: /note="Description of Artificial Sequence: Synthetic peptide"
PARRRLM

SEQ ID NO: 878 - protein, 4 aa, Artificial Sequence
  source: /note="Description of Artificial Sequence: Synthetic peptide"
LQED

SEQ ID NO: 879 - protein, 11 aa, Artificial Sequence
  source: /note="Description of Artificial Sequence: Synthetic peptide"
MSTPARRRLMR

SEQ ID NO: 880 - protein, 8 aa, Artificial Sequence
  source: /note="Description of Artificial Sequence: Synthetic peptide"
PARRRLMR

SEQ ID NO: 881 - protein, 6 aa, Artificial Sequence
  source: /note="Description of Artificial Sequence: Synthetic peptide"
ARRRLM

SEQ ID NO: 882 - protein, 8 aa, Artificial Sequence
  source: /note="Description of Artificial Sequence: Synthetic peptide"
DFKRLQED

SEQ ID NO: 883 - protein, 6 aa, Artificial Sequence
  source: /note="Description of Artificial Sequence: Synthetic peptide"
MSTPAR

SEQ ID NO: 884 - protein, 6 aa, Artificial Sequence
  source: /note="Description of Artificial Sequence: Synthetic peptide"
RLMRDF

SEQ ID NO: 885 - protein, 5 aa, Artificial Sequence
  source: /note="Description of Artificial Sequence: Synthetic peptide"
RLQED

SEQ ID NO: 886 - protein, 4 aa, Artificial Sequence
  source: /note="Description of Artificial Sequence: Synthetic peptide"
MTEL

SEQ ID NO: 887 - protein, 6 aa, Artificial Sequence
  source: /note="Description of Artificial Sequence: Synthetic peptide"
SALLLR

SEQ ID NO: 888 - protein, 6 aa, Artificial Sequence
  source: /note="Description of Artificial Sequence: Synthetic peptide"
IKREFK

SEQ ID NO: 889 - protein, 8 aa, Artificial Sequence
  source: /note="Description of Artificial Sequence: Synthetic peptide"
QLAELNKN

SEQ ID NO: 890 - protein, 7 aa, Artificial Sequence
  source: /note="Description of Artificial Sequence: Synthetic peptide"
MTELQSA

SEQ ID NO: 891 - protein, 4 aa, Artificial Sequence
  source: /note="Description of Artificial Sequence: Synthetic peptide"
LQSA

SEQ ID NO: 892 - protein, 10 aa, Artificial Sequence
  source: /note="Description of Artificial Sequence: Synthetic peptide"
MTELQSALLL

SEQ ID NO: 893 - protein, 7 aa, Artificial Sequence
  source: /note="Description of Artificial Sequence: Synthetic peptide"
LQSALLL

SEQ ID NO: 894 - protein, 5 aa, Artificial Sequence
  source: /note="Description of Artificial Sequence: Synthetic peptide"
ELNKN

SEQ ID NO: 895 - protein, 11 aa, Artificial Sequence
  source: /note="Description of Artificial Sequence: Synthetic peptide"
MTELQSALLLR

SEQ ID NO: 896 - protein, 8 aa, Artificial Sequence
  source: /note="Description of Artificial Sequence: Synthetic peptide"
LQSALLLR

SEQ ID NO: 897 - protein, 6 aa, Artificial Sequence
  source: /note="Description of Artificial Sequence: Synthetic peptide"
QSALLL

SEQ ID NO: 898 - protein, 9 aa, Artificial Sequence
  source: /note="Description of Artificial Sequence: Synthetic peptide"
RQLAELNKN

SEQ ID NO: 899 - protein, 6 aa, Artificial Sequence
  source: /note="Description of Artificial Sequence: Synthetic peptide"
LMRDFK

SEQ ID NO: 900 - protein, 6 aa, Artificial Sequence
  source: /note="Description of Artificial Sequence: Synthetic peptide"
MTELQS

SEQ ID NO: 901 - protein, 6 aa, Artificial Sequence
  source: /note="Description of Artificial Sequence: Synthetic peptide"
LLLRRQ

SEQ ID NO: 902 - protein, 6 aa, Artificial Sequence
  source: /note="Description of Artificial Sequence: Synthetic peptide"
AELNKN

SEQ ID NO: 903 - protein, 4 aa, Artificial Sequence
  source: /note="Description of Artificial Sequence: Synthetic peptide"
MAGT

SEQ ID NO: 904 - protein, 6 aa, Artificial Sequence
  source: /note="Description of Artificial Sequence: Synthetic peptide"
LLRRQL

SEQ ID NO: 905 - protein, 6 aa, Artificial Sequence
  source: /note="Description of Artificial Sequence: Synthetic peptide"
LKRLMA

SEQ ID NO: 906 - protein, 7 aa, Artificial Sequence
  source: /note="Description of Artificial Sequence: Synthetic peptide"
YKQLTLN

SEQ ID NO: 907 - protein, 7 aa, Artificial Sequence
  source: /note="Description of Artificial Sequence: Synthetic peptide"
MAGTALK

SEQ ID NO: 908 - protein, 4 aa, Artificial Sequence
  source: /note="Description of Artificial Sequence: Synthetic peptide"
TALK

SEQ ID NO: 909 - protein, 10 aa, Artificial Sequence
  source: /note="Description of Artificial Sequence: Synthetic peptide"
MAGTALKRLM

SEQ ID NO: 910 - protein, 7 aa, Artificial Sequence
  source: /note="Description of Artificial Sequence: Synthetic peptide"
TALKRLM

SEQ ID NO: 911 - protein, 4 aa, Artificial Sequence
  source: /note="Description of Artificial Sequence: Synthetic peptide"
LTLN

SEQ ID NO: 912 - protein, 11 aa, Artificial Sequence
  source: /note="Description of Artificial Sequence: Synthetic peptide"
MAGTALKRLMA

SEQ ID NO: 913 - protein, 8 aa, Artificial Sequence
  source: /note="Description of Artificial Sequence: Synthetic peptide"
TALKRLMA

SEQ ID NO: 914 - protein, 6 aa, Artificial Sequence
  source: /note="Description of Artificial Sequence: Synthetic peptide"
ALKRLM

SEQ ID NO: 915 - protein, 8 aa, Artificial Sequence
  source: /note="Description of Artificial Sequence: Synthetic peptide"
EYKQLTLN

SEQ ID NO: 916 - protein, 6 aa, Artificial Sequence
  source: /note="Description of Artificial Sequence: Synthetic peptide"
MAGTAL

SEQ ID NO: 917 - protein, 6 aa, Artificial Sequence
  source: /note="Description of Artificial Sequence: Synthetic peptide"
RLMAEY

SEQ ID NO: 918 - protein, 5 aa, Artificial Sequence
  source: /note="Description of Artificial Sequence: Synthetic peptide"
QLTLN

SEQ ID NO: 919 - protein, 8 aa, Artificial Sequence
  source: /note="Description of Artificial Sequence: Synthetic peptide"
MARPLVPS

SEQ ID NO: 920 - protein, 11 aa, Artificial Sequence
  source: /note="Description of Artificial Sequence: Synthetic peptide"
MARPLVPSSQK

SEQ ID NO: 921 - protein, 4 aa, Artificial Sequence
  source: /note="Description of Artificial Sequence: Synthetic peptide"
SSQK

SEQ ID NO: 922 - protein, 14 aa, Artificial Sequence
  source: /note="Description of Artificial Sequence: Synthetic peptide"
MARPLVPSSQKALL

SEQ ID NO: 923 - protein, 7 aa, Artificial Sequence
  source: /note="Description of Artificial Sequence: Synthetic peptide"
SSQKALL

SEQ ID NO: 924 - protein, 15 aa, Artificial Sequence
  source: /note="Description of Artificial Sequence: Synthetic peptide"
MARPLVPSSQKALLL

SEQ ID NO: 925 - protein, 8 aa, Artificial Sequence
  source: /note="Description of Artificial Sequence: Synthetic peptide"
SSQKALLL

SEQ ID NO: 926 - protein, 7 aa, Artificial Sequence
  source: /note="Description of Artificial Sequence: Synthetic peptide"
MARPLVP

SEQ ID NO: 927 - protein, 6 aa, Artificial Sequence
  source: /note="Description of Artificial Sequence: Synthetic peptide"
LMAEYK

SEQ ID NO: 928 - protein, 6 aa, Artificial Sequence
  source: /note="Description of Artificial Sequence: Synthetic peptide"
QKALLL

SEQ ID NO: 929 - protein, 6 aa, Artificial Sequence
  source: /note="Description of Artificial Sequence: Synthetic peptide"
SQKALL

SEQ ID NO: 930 - protein, 6 aa, Artificial Sequence
  source: /note="Description of Artificial Sequence: Synthetic peptide"
LLLELK

SEQ ID NO: 931 - protein, 7 aa, Artificial Sequence
  source: /note="Description of Artificial Sequence: Synthetic peptide"
LKGLQEE

SEQ ID NO: 932 - protein, 4 aa, Artificial Sequence
  source: /note="Description of Artificial Sequence: Synthetic peptide"
LQEE

SEQ ID NO: 933 - protein, 8 aa, Artificial Sequence
  source: /note="Description of Artificial Sequence: Synthetic peptide"
ELKGLQEE

SEQ ID NO: 934 - protein, 6 aa, Artificial Sequence
  source: /note="Description of Artificial Sequence: Synthetic peptide"
LMLELK

SEQ ID NO: 935 - protein, 8 aa, Artificial Sequence
  source: /note="Description of Artificial Sequence: Synthetic peptide"
MAQQQMTS

SEQ ID NO: 936 - protein, 11 aa, Artificial Sequence
  source: /note="Description of Artificial Sequence: Synthetic peptide"
MAQQQMTSSQK

SEQ ID NO: 937 - protein, 4 aa, Artificial Sequence
  source: /note="Description of Artificial Sequence: Synthetic peptide"
SSQK

SEQ ID NO: 938 - protein, 14 aa, Artificial Sequence
  source: /note="Description of Artificial Sequence: Synthetic peptide"
MAQQQMTSSQKALM

SEQ ID NO: 939 - protein, 7 aa, Artificial Sequence
  source: /note="Description of Artificial Sequence: Synthetic peptide"
SSQKALM

SEQ ID NO: 940 - protein, 15 aa, Artificial Sequence
  source: /note="Description of Artificial Sequence: Synthetic peptide"
MAQQQMTSSQKALML

SEQ ID NO: 941 - protein, 8 aa, Artificial Sequence
  source: /note="Description of Artificial Sequence: Synthetic peptide"
SSQKALML

SEQ ID NO: 942 - protein, 7 aa, Artificial Sequence
  source: /note="Description of Artificial Sequence: Synthetic peptide"
MAQQQMT

SEQ ID NO: 943 - protein, 6 aa, Artificial Sequence
  source: /note="Description of Artificial Sequence: Synthetic peptide"
IQKELS

SEQ ID NO: 944 - protein, 6 aa, Artificial Sequence
  source: /note="Description of Artificial Sequence: Synthetic peptide"
QKALML

SEQ ID NO: 945 - protein, 6 aa, Artificial Sequence
  source: /note="Description of Artificial Sequence: Synthetic peptide"
SQKALM

SEQ ID NO: 946 - protein, 6 aa, Artificial Sequence
  source: /note="Description of Artificial Sequence: Synthetic peptide"
IHKELN

SEQ ID NO: 947 - protein, 7 aa, Artificial Sequence
  source: /note="Description of Artificial Sequence: Synthetic peptide"
LKSLQEE

SEQ ID NO: 948 - protein, 4 aa, Artificial Sequence
  source: /note="Description of Artificial Sequence: Synthetic peptide"
AYLL

SEQ ID NO: 949 - protein, 8 aa, Artificial Sequence
  source: /note="Description of Artificial Sequence: Synthetic peptide"
ELKSLQEE

SEQ ID NO: 950 - protein, 6 aa, Artificial Sequence
  source: /note="Description of Artificial Sequence: Synthetic peptide"
INKELS

SEQ ID NO: 951 - protein, 4 aa, Artificial Sequence
  source: /note="Description of Artificial Sequence: Synthetic peptide"
MALK

SEQ ID NO: 952 - protein, 7 aa, Artificial Sequence
  source: /note="Description of Artificial Sequence: Synthetic peptide"
MALKRIQ

SEQ ID NO: 953 - protein, 8 aa, Artificial Sequence
  source: /note="Description of Artificial Sequence: Synthetic peptide"
MALKRIQK

SEQ ID NO: 954 - protein, 6 aa, Artificial Sequence
  source: /note="Description of Artificial Sequence: Synthetic peptide"
LKRIQK

SEQ ID NO: 955 - protein, 6 aa, Artificial Sequence
  source: /note="Description of Artificial Sequence: Synthetic peptide"
ALKRIQ

SEQ ID NO: 956 - protein, 6 aa, Artificial Sequence
  source: /note="Description of Artificial Sequence: Synthetic peptide"
RIQKEL

SEQ ID NO: 957 - protein, 7 aa, Artificial Sequence
  source: /note="Description of Artificial Sequence: Synthetic peptide"
LSDLQRD

SEQ ID NO: 958 - protein, 4 aa, Artificial Sequence
  source: /note="Description of Artificial Sequence: Synthetic peptide"
LQRD

SEQ ID NO: 959 - protein, 8 aa, Artificial Sequence
  source: /note="Description of Artificial Sequence: Synthetic peptide"
ELSDLQRD

SEQ ID NO: 960 - protein, 5 aa, Artificial Sequence
  source: /note="Description of Artificial Sequence: Synthetic peptide"
DLQRD

SEQ ID NO: 961 - protein, 5 aa, Artificial Sequence
  source: /note="Description of Artificial Sequence: Synthetic peptide"
EIQKN

SEQ ID NO: 962 - protein, 7 aa, Artificial Sequence
  source: /note="Description of Artificial Sequence: Synthetic peptide"
MALKRIH

SEQ ID NO: 963 - protein, 8 aa, Artificial Sequence
  source: /note="Description of Artificial Sequence: Synthetic peptide"
MALKRIHK

SEQ ID NO: 964 - protein, 6 aa, Artificial Sequence
  source: /note="Description of Artificial Sequence: Synthetic peptide"
LKRIHK

SEQ ID NO: 965 - protein, 6 aa, Artificial Sequence
  source: /note="Description of Artificial Sequence: Synthetic peptide"
ALKRIH

SEQ ID NO: 966 - protein, 6 aa, Artificial Sequence
  source: /note="Description of Artificial Sequence: Synthetic peptide"
RIHKEL

SEQ ID NO: 967 - protein, 7 aa, Artificial Sequence
  source: /note="Description of Artificial Sequence: Synthetic peptide"
LNDLARD

SEQ ID NO: 968 - protein, 4 aa, Artificial Sequence
  source: /note="Description of Artificial Sequence: Synthetic peptide"
LARD

SEQ ID NO: 969 - protein, 8 aa, Artificial Sequence
  source: /note="Description of Artificial Sequence: Synthetic peptide"
ELNDLARD

SEQ ID NO: 970 - protein, 5 aa, Artificial Sequence
  source: /note="Description of Artificial Sequence: Synthetic peptide"
DLARD

SEQ ID NO: 971 - protein, 6 aa, Artificial Sequence
  source: /note="Description of Artificial Sequence: Synthetic peptide"
LLRKQL

SEQ ID NO: 972 - protein, 7 aa, Artificial Sequence
  source: /note="Description of Artificial Sequence: Synthetic peptide"
MALKRIN

SEQ ID NO: 973 - protein, 8 aa, Artificial Sequence
  source: /note="Description of Artificial Sequence: Synthetic peptide"
MALKRINK

SEQ ID NO: 974 - protein, 6 aa, Artificial Sequence
  source: /note="Description of Artificial Sequence: Synthetic peptide"
LKRINK

SEQ ID NO: 975 - protein, 6 aa, Artificial Sequence
  source: /note="Description of Artificial Sequence: Synthetic peptide"
ALKRIN

SEQ ID NO: 976 - protein, 6 aa, Artificial Sequence
  source: /note="Description of Artificial Sequence: Synthetic peptide"
RINKEL

SEQ ID NO: 977 - protein, 7 aa, Artificial Sequence
  source: /note="Description of Artificial Sequence: Synthetic peptide"
LSDLARD

SEQ ID NO: 978 - protein, 4 aa, Artificial Sequence
  source: /note="Description of Artificial Sequence: Synthetic peptide"
LARD

SEQ ID NO: 979 - protein, 8 aa, Artificial Sequence
  source: /note="Description of Artificial Sequence: Synthetic peptide"
ELSDLARD

SEQ ID NO: 980 - protein, 5 aa, Artificial Sequence
  source: /note="Description of Artificial Sequence: Synthetic peptide"
DLARD

SEQ ID NO: 981 - protein, 7 aa, Artificial Sequence
  source: /note="Description of Artificial Sequence: Synthetic peptide"
MPSSASR

SEQ ID NO: 982 - protein, 7 aa, Artificial Sequence
  source: /note="Description of Artificial Sequence: Synthetic peptide"
MPSSASE

SEQ ID NO: 983 - protein, 6 aa, Artificial Sequence
  source: /note="Description of Artificial Sequence: Synthetic peptide"
QLKEIQ

SEQ ID NO: 984 - protein, 8 aa, Artificial Sequence
  source: /note="Description of Artificial Sequence: Synthetic peptide"
QLKEIQKN

SEQ ID NO: 985 - protein, 6 aa, Artificial Sequence
  source: /note="Description of Artificial Sequence: Synthetic peptide"
SEQLLR

SEQ ID NO: 986 - protein, 4 aa, Artificial Sequence
  source: /note="Description of Artificial Sequence: Synthetic peptide"
MPSS

SEQ ID NO: 987 - protein, 7 aa, Artificial Sequence
  source: /note="Description of Artificial Sequence: Synthetic peptide"
LTDLQRD

SEQ ID NO: 988 - protein, 8 aa, Artificial Sequence
  source: /note="Description of Artificial Sequence: Synthetic peptide"
ASRQLLRK

SEQ ID NO: 989 - protein, 8 aa, Artificial Sequence
  source: /note="Description of Artificial Sequence: Synthetic peptide"
ELTDLQRD

SEQ ID NO: 990 - protein, 8 aa, Artificial Sequence
  source: /note="Description of Artificial Sequence: Synthetic peptide"
ASEQLLRK

SEQ ID NO: 991 - protein, 8 aa, Artificial Sequence
  source: /note="Description of Artificial Sequence: Synthetic peptide"
KNSKLLST

SEQ ID NO: 992 - protein, 11 aa, Artificial Sequence
  source: /note="Description of Artificial Sequence: Synthetic peptide"
KNSKLLSTSAK

SEQ ID NO: 993 - protein, 4 aa, Artificial Sequence
  source: /note="Description of Artificial Sequence: Synthetic peptide"
TSAK

SEQ ID NO: 994 - protein, 14 aa, Artificial Sequence
  source: /note="Description of Artificial Sequence: Synthetic peptide"
KNSKLLSTSAKRIQ

SEQ ID NO: 995 - protein, 7 aa, Artificial Sequence
  source: /note="Description of Artificial Sequence: Synthetic peptide"
TSAKRIQ

SEQ ID NO: 996 - protein, 15 aa, Artificial Sequence
  source: /note="Description of Artificial Sequence: Synthetic peptide"
KNSKLLSTSAKRIQK

SEQ ID NO: 997 - protein, 8 aa, Artificial Sequence
  source: /note="Description of Artificial Sequence: Synthetic peptide"
TSAKRIQK

SEQ ID NO: 998 - protein, 7 aa, Artificial Sequence
  source: /note="Description of Artificial Sequence: Synthetic peptide"
KNSKLLS

SEQ ID NO: 999 - protein, 10 aa, Artificial Sequence
  source: /note="Description of Artificial Sequence: Synthetic peptide"
KNSKLLSTSA

SEQ ID NO: 1000 - protein, 6 aa, Artificial Sequence
  source: /note="Description of Artificial Sequence: Synthetic peptide"
AKRIQK

SEQ ID NO: 1001 - protein, 6 aa, Artificial Sequence
  source: /note="Description of Artificial Sequence: Synthetic peptide"
SAKRIQ

SEQ ID NO: 1002 - protein, 12 aa, Artificial Sequence
  source: /note="Description of Artificial Sequence: Synthetic peptide"
MPSSASRQLLRK

SEQ ID NO: 1003 - protein, 7 aa, Artificial Sequence
  source: /note="Description of Artificial Sequence: Synthetic peptide"
LADITLD

SEQ ID NO: 1004 - protein, 4 aa, Artificial Sequence
  source: /note="Description of Artificial Sequence: Synthetic peptide"
ITLD

SEQ ID NO: 1005 - protein, 8 aa, Artificial Sequence
  source: /note="Description of Artificial Sequence: Synthetic peptide"
ELADITLD

SEQ ID NO: 1006 - protein, 5 aa, Artificial Sequence
  source: /note="Description of Artificial Sequence: Synthetic peptide"
DITLD

SEQ ID NO: 1007 - protein, 8 aa, Artificial Sequence
  source: /note="Description of Artificial Sequence: Synthetic peptide"
KTAAKLST

SEQ ID NO: 1008 - protein, 11 aa, Artificial Sequence
  source: /note="Description of Artificial Sequence: Synthetic peptide"
KTAAKLSTSAK

SEQ ID NO: 1009 - protein, 12 aa, Artificial Sequence
  source: /note="Description of Artificial Sequence: Synthetic peptide"
MPSSASEQLLRK

SEQ ID NO: 1010 - protein, 14 aa, Artificial Sequence
  source: /note="Description of Artificial Sequence: Synthetic peptide"
KTAAKLSTSAKRIQ

SEQ ID NO: 1011 - protein, 4 aa, Artificial Sequence
  source: /note="Description of Artificial Sequence: Synthetic peptide"
IQKN

SEQ ID NO: 1012 - protein, 15 aa, Artificial Sequence
  source: /note="Description of Artificial Sequence: Synthetic peptide"
KTAAKLSTSAKRIQK

SEQ ID NO: 1013 - protein, 7 aa, Artificial Sequence
  source: /note="Description of Artificial Sequence: Synthetic peptide"
ASRQLLR

SEQ ID NO: 1014 - protein, 7 aa, Artificial Sequence
  source: /note="Description of Artificial Sequence: Synthetic peptide"
KTAAKLS

SEQ ID NO: 1015 - protein, 10 aa, Artificial Sequence
  source: /note="Description of Artificial Sequence: Synthetic peptide"
KTAAKLSTSA

SEQ ID NO: 1016 - protein, 7 aa, Artificial Sequence
  source: /note="Description of Artificial Sequence: Synthetic peptide"
ASEQLLR

SEQ ID NO: 1017 - protein, 11 aa, Artificial Sequence
  source: /note="Description of Artificial Sequence: Synthetic peptide"
MPSSASRQLLR

SEQ ID NO: 1018 - protein, 11 aa, Artificial Sequence
  source: /note="Description of Artificial Sequence: Synthetic peptide"
MPSSASEQLLR

SEQ ID NO: 1019 - protein, 7 aa, Artificial Sequence
  source: /note="Description of Artificial Sequence: Synthetic peptide"
LAEITLD

SEQ ID NO: 1020 - protein, 5 aa, Artificial Sequence
  source: /note="Description of Artificial Sequence: Synthetic peptide"
LKEIQ

SEQ ID NO: 1021 - protein, 8 aa, Artificial Sequence
  source: /note="Description of Artificial Sequence: Synthetic peptide"
ELAEITLD

SEQ ID NO: 1022 - protein, 5 aa, Artificial Sequence
  source: /note="Description of Artificial Sequence: Synthetic peptide"
EITLD

SEQ ID NO: 1023 - protein, 8 aa, Artificial Sequence
  source: /note="Description of Artificial Sequence: Synthetic peptide"
KTTAKLST

SEQ ID NO: 1024 - protein, 11 aa, Artificial Sequence
  source: /note="Description of Artificial Sequence: Synthetic peptide"
KTTAKLSTSAK

SEQ ID NO: 1025 - protein, 7 aa, Artificial Sequence
  source: /note="Description of Artificial Sequence: Synthetic peptide"
LKEIQKN

SEQ ID NO: 1026 - protein, 14 aa, Artificial Sequence
  source: /note="Description of Artificial Sequence: Synthetic peptide"
KTTAKLSTSAKRIQ

SEQ ID NO: 1027 - protein, 4 aa, Artificial Sequence
  source: /note="Description of Artificial Sequence: Synthetic peptide"
ASRQ

SEQ ID NO: 1028 - protein, 15 aa, Artificial Sequence
  source: /note="Description of Artificial Sequence: Synthetic peptide"
KTTAKLSTSAKRIQK

SEQ ID NO: 1029 - protein, 4 aa, Artificial Sequence
  source: /note="Description of Artificial Sequence: Synthetic peptide"
ASEQ

SEQ ID NO: 1030 - protein, 7 aa, Artificial Sequence
  source: /note="Description of Artificial Sequence: Synthetic peptide"
KTTAKLS

SEQ ID NO: 1031 - protein, 10 aa, Artificial Sequence
  source: /note="Description of Artificial Sequence: Synthetic peptide"
KTTAKLSTSA

SEQ ID NO: 1032 - protein, 8 aa, Artificial Sequence
  source: /note="Description of Artificial Sequence: Synthetic peptide"
MPSSASRQ

SEQ ID NO: 1033 - protein, 8 aa, Artificial Sequence
  source: /note="Description of Artificial Sequence: Synthetic peptide"
MPSSASEQ

SEQ ID NO: 1034 - protein, 5 aa, Artificial Sequence
  source: /note="Description of Artificial Sequence: Synthetic peptide"
LKEIQ

SEQ ID NO: 1035 - protein, 7 aa, Artificial Sequence
  source: /note="Description of Artificial Sequence: Synthetic peptide"
LKEIQKN

SEQ ID NO: 1036 - protein, 6 aa, Artificial Sequence
  source: /note="Description of Artificial Sequence: Synthetic peptide"
EQLLRK

SEQ ID NO: 1037 - protein, 5 aa, Artificial Sequence
  source: /note="Description of Artificial Sequence: Synthetic peptide"
MPSSA

SEQ ID NO: 1038 - protein, 6 aa, Artificial Sequence
  source: /note="Description of Artificial Sequence: Synthetic peptide"
AQERKA

SEQ ID NO: 1039 - protein, 5 aa, Artificial Sequence
  source: /note="Description of Artificial Sequence: Synthetic peptide"
MHGRA

SEQ ID NO: 1040 - protein, 8 aa, Artificial Sequence
  source: /note="Description of Artificial Sequence: Synthetic peptide"
MHGRAYLL

SEQ ID NO: 1041 - protein, 11 aa, Artificial Sequence
  source: /note="Description of Artificial Sequence: Synthetic peptide"
MHGRAYLLLHR

SEQ ID NO: 1042 - protein, 7 aa, Artificial Sequence
  source: /note="Description of Artificial Sequence: Synthetic peptide"
AYLLLHR

SEQ ID NO: 1043 - protein, 12 aa, Artificial Sequence
  source: /note="Description of Artificial Sequence: Synthetic peptide"
MHGRAYLLLHRD

SEQ ID NO: 1044 - protein, 8 aa, Artificial Sequence
  source: /note="Description of Artificial Sequence: Synthetic peptide"
AYLLLHRD

SEQ ID NO: 1045 - protein, 4 aa, Artificial Sequence
  source: /note="Description of Artificial Sequence: Synthetic peptide"
MHGR

SEQ ID NO: 1046 - protein, 7 aa, Artificial Sequence
  source: /note="Description of Artificial Sequence: Synthetic peptide"
MHGRAYL

SEQ ID NO: 1047 - protein, 6 aa, Artificial Sequence
  source: /note="Description of Artificial Sequence: Synthetic peptide"
LLLHRD

SEQ ID NO: 1048 - protein, 6 aa, Artificial Sequence
  source: /note="Description of Artificial Sequence: Synthetic peptide"
YLLLHR

SEQ ID NO: 1049 - protein, 6 aa, Artificial Sequence
  source: /note="Description of Artificial Sequence: Synthetic peptide"
LHRDFC

SEQ ID NO: 1050 - protein, 7 aa, Artificial Sequence
  source: /note="Description of Artificial Sequence: Synthetic peptide"
CDLKENN

SEQ ID NO: 1051 - protein, 4 aa, Artificial Sequence
  source: /note="Description of Artificial Sequence: Synthetic peptide"
KENN

SEQ ID NO: 1052 - protein, 8 aa, Artificial Sequence
  source: /note="Description of Artificial Sequence: Synthetic peptide"
FCDLKENN

SEQ ID NO: 1053 - protein, 5 aa, Artificial Sequence
  source: /note="Description of Artificial Sequence: Synthetic peptide"
LKENN

SEQ ID NO: 1054 - protein, 10 aa, Artificial Sequence
  source: /note="Description of Artificial Sequence: Synthetic peptide"
METRYNLKSP

SEQ ID NO: 1055 - protein, 13 aa, Artificial Sequence
  source: /note="Description of Artificial Sequence: Synthetic peptide"
METRYNLKSPAVK

SEQ ID NO: 1056 - protein, 4 aa, Artificial Sequence
  source: /note="Description of Artificial Sequence: Synthetic peptide"
PAVK

SEQ ID NO: 1057 - protein, 16 aa, Artificial Sequence
  source: /note="Description of Artificial Sequence: Synthetic peptide"
METRYNLKSPAVKRLM

SEQ ID NO: 1058 - protein, 7 aa, Artificial Sequence
  source: /note="Description of Artificial Sequence: Synthetic peptide"
PAVKRLM

SEQ ID NO: 1059 - protein, 17 aa, Artificial Sequence
  source: /note="Description of Artificial Sequence: Synthetic peptide"
METRYNLKSPAVKRLMK

SEQ ID NO: 1060 - protein, 8 aa, Artificial Sequence
  source: /note="Description of Artificial Sequence: Synthetic peptide"
PAVKRLMK

SEQ ID NO: 1061 - protein, 9 aa, Artificial Sequence
  source: /note="Description of Artificial Sequence: Synthetic peptide"
METRYNLKS

SEQ ID NO: 1062 - protein, 12 aa, Artificial Sequence
  source: /note="Description of Artificial Sequence: Synthetic peptide"
METRYNLKSPAV

SEQ ID NO: 1063 - protein, 6 aa, Artificial Sequence
  source: /note="Description of Artificial Sequence: Synthetic peptide"
VKRLMK

SEQ ID NO: 1064 - protein, 6 aa, Artificial Sequence
  source: /note="Description of Artificial Sequence: Synthetic peptide"
AVKRLM

SEQ ID NO: 1065 - protein, 6 aa, Artificial Sequence
  source: /note="Description of Artificial Sequence: Synthetic peptide"
IQKELT

SEQ ID NO: 1066 - protein, 6 aa, Artificial Sequence
  source: /note="Description of Artificial Sequence: Synthetic peptide"
IQKELA

SEQ ID NO: 1067 - protein, 6 aa, Artificial Sequence
  source: /note="Description of Artificial Sequence: Synthetic peptide"
RLMKEA

SEQ ID NO: 1068 - protein, 7 aa, Artificial Sequence
  source: /note="Description of Artificial Sequence: Synthetic peptide"
AAELKDP

SEQ ID NO: 1069 - protein, 4 aa, Artificial Sequence
  source: /note="Description of Artificial Sequence: Synthetic peptide"
LKDP

SEQ ID NO: 1070 - protein, 8 aa, Artificial Sequence
  source: /note="Description of Artificial Sequence: Synthetic peptide"
EAAELKDP

SEQ ID NO: 1071 - protein, 5 aa, Artificial Sequence
  source: /note="Description of Artificial Sequence: Synthetic peptide"
ELKDP

SEQ ID NO: 1072 - protein, 12 aa, Artificial Sequence
  source: /note="Description of Artificial Sequence: Synthetic peptide"
MSSTSSKRAPTT

SEQ ID NO: 1073 - protein, 15 aa, Artificial Sequence
  source: /note="Description of Artificial Sequence: Synthetic peptide"
MSSTSSKRAPTTATQ

SEQ ID NO: 1074 - protein, 4 aa, Artificial Sequence
  source: /note="Description of Artificial Sequence: Synthetic peptide"
TATQ

SEQ ID NO: 1075 - protein, 18 aa, Artificial Sequence
  source: /note="Description of Artificial Sequence: Synthetic peptide"
MSSTSSKRAPTTATQRLK

SEQ ID NO: 1076 - protein, 7 aa, Artificial Sequence
  source: /note="Description of Artificial Sequence: Synthetic peptide"
TATQRLK

SEQ ID NO: 1077 - protein, 19 aa, Artificial Sequence
  source: /note="Description of Artificial Sequence: Synthetic peptide"
MSSTSSKRAPTTATQRLKQ

SEQ ID NO: 1078 - protein, 8 aa, Artificial Sequence
  source: /note="Description of Artificial Sequence: Synthetic peptide"
TATQRLKQ

SEQ ID NO: 1079 - protein, 11 aa, Artificial Sequence
  source: /note="Description of Artificial Sequence: Synthetic peptide"
MSSTSSKRAPT

SEQ ID NO: 1080 - protein, 14 aa, Artificial Sequence
  source: /note="Description of Artificial Sequence: Synthetic peptide"
MSSTSSKRAPTTAT

SEQ ID NO: 1081 - protein, 6 aa, Artificial Sequence
  source: /note="Description of Artificial Sequence: Synthetic peptide"
TQRLKQ

SEQ ID NO: 1082 - protein, 6 aa, Artificial Sequence
  source: /note="Description of Artificial Sequence: Synthetic peptide"
ATQRLK

SEQ ID NO: 1083 - protein, 6 aa, Artificial Sequence
  source: /note="Description of Artificial Sequence: Synthetic peptide"
RLKQDY

SEQ ID NO: 1084 - protein, 7 aa, Artificial Sequence
  source: /note="Description of Artificial Sequence: Synthetic peptide"
YLRIKKD

SEQ ID NO: 1085 - protein, 4 aa, Artificial Sequence
  source: /note="Description of Artificial Sequence: Synthetic peptide"
IKKD

SEQ ID NO: 1086 - protein, 8 aa, Artificial Sequence
  source: /note="Description of Artificial Sequence: Synthetic peptide"
DYLRIKKD

SEQ ID NO: 1087 - protein, 5 aa, Artificial Sequence
  source: /note="Description of Artificial Sequence: Synthetic peptide"
RIKKD

SEQ ID NO: 1088 - protein, 6 aa, Artificial Sequence
  source: /note="Description of Artificial Sequence: Synthetic peptide"
MAGLPR

SEQ ID NO: 1089 - protein, 4 aa, Artificial Sequence
  source: /note="Description of Artificial Sequence: Synthetic peptide"
GLPR

SEQ ID NO: 1090 - protein, 9 aa, Artificial Sequence
  source: /note="Description of Artificial Sequence: Synthetic peptide"
MAGLPRRII

SEQ ID NO: 1091 - protein, 7 aa, Artificial Sequence
  source: /note="Description of Artificial Sequence: Synthetic peptide"
GLPRRII

SEQ ID NO: 1092 - protein, 10 aa, Artificial Sequence
  source: /note="Description of Artificial Sequence: Synthetic peptide"
MAGLPRRIIK

SEQ ID NO: 1093 - protein, 8 aa, Artificial Sequence
  source: /note="Description of Artificial Sequence: Synthetic peptide"
GLPRRIIK

SEQ ID NO: 1094 - protein, 5 aa, Artificial Sequence
  source: /note="Description of Artificial Sequence: Synthetic peptide"
MAGLP

SEQ ID NO: 1095 - protein, 7 aa, Artificial Sequence
  source: /note="Description of Artificial Sequence: Synthetic peptide"
PRRIIKE

SEQ ID NO: 1096 - protein, 6 aa, Artificial Sequence
  source: /note="Description of Artificial Sequence: Synthetic peptide"
LPRRII

SEQ ID NO: 1097 - protein, 6 aa, Artificial Sequence
  source: /note="Description of Artificial Sequence: Synthetic peptide"
RIIKET

SEQ ID NO: 1098 - protein, 7 aa, Artificial Sequence
  source: /note="Description of Artificial Sequence: Synthetic peptide"
TQRLLAE

SEQ ID NO: 1099 - protein, 4 aa, Artificial Sequence
  source: /note="Description of Artificial Sequence: Synthetic peptide"
LLAE

SEQ ID NO: 1100 - protein, 8 aa, Artificial Sequence
  source: /note="Description of Artificial Sequence: Synthetic peptide"
ETQRLLAE

SEQ ID NO: 1101 - protein, 5 aa, Artificial Sequence
  source: /note="Description of Artificial Sequence: Synthetic peptide"
RLLAE

SEQ ID NO: 1102 - protein, 6 aa, Artificial Sequence
  source: /note="Description of Artificial Sequence: Synthetic peptide"
MAELPH

SEQ ID NO: 1103 - protein, 4 aa, Artificial Sequence
  source: /note="Description of Artificial Sequence: Synthetic peptide"
ELPH

SEQ ID NO: 1104 - protein, 9 aa, Artificial Sequence
  source: /note="Description of Artificial Sequence: Synthetic peptide"
MAELPHRII

SEQ ID NO: 1105 - protein, 7 aa, Artificial Sequence
  source: /note="Description of Artificial Sequence: Synthetic peptide"
ELPHRII

SEQ ID NO: 1106 - protein, 10 aa, Artificial Sequence
  source: /note="Description of Artificial Sequence: Synthetic peptide"
MAELPHRIIK

SEQ ID NO: 1107 - protein, 8 aa, Artificial Sequence
  source: /note="Description of Artificial Sequence: Synthetic peptide"
ELPHRIIK

SEQ ID NO: 1108 - protein, 5 aa, Artificial Sequence
  source: /note="Description of Artificial Sequence: Synthetic peptide"
MAELP

SEQ ID NO: 1109 - protein, 6 aa, Artificial Sequence
  source: /note="Description of Artificial Sequence: Synthetic peptide"
PHRIIK

SEQ ID NO: 1110 - protein, 6 aa, Artificial Sequence
  source: /note="Description of Artificial Sequence: Synthetic peptide"
LPHRII

SEQ ID NO: 1111 - protein, 7 aa, Artificial Sequence
  source: /note="Description of Artificial Sequence: Synthetic peptide"
RIIKETQ

SEQ ID NO: 1112 - protein, 4 aa, Artificial Sequence
  source: /note="Description of Artificial Sequence: Synthetic peptide"
ALSR

SEQ ID NO: 1113 - protein, 6 aa, Artificial Sequence
  source: /note="Description of Artificial Sequence: Synthetic peptide"
LRIQKD

SEQ ID NO: 1114 - protein, 6 aa, Artificial Sequence
  source: /note="Description of Artificial Sequence: Synthetic peptide"
KKASAA

SEQ ID NO: 1115 - protein, 6 aa, Artificial Sequence
  source: /note="Description of Artificial Sequence: Synthetic peptide"
DKLLVK

SEQ ID NO: 1116 - protein, 5 aa, Artificial Sequence
  source: /note="Description of Artificial Sequence: Synthetic peptide"
MQRAS

SEQ ID NO: 1117 - protein, 4 aa, Artificial Sequence
  source: /note="Description of Artificial Sequence: Synthetic peptide"
QRAS

SEQ ID NO: 1118 - protein, 8 aa, Artificial Sequence
  source: /note="Description of Artificial Sequence: Synthetic peptide"
MQRASRLK

SEQ ID NO: 1119 - protein, 7 aa, Artificial Sequence
  source: /note="Description of Artificial Sequence: Synthetic peptide"
QRASRLK

SEQ ID NO: 1120 - protein, 9 aa, Artificial Sequence
  source: /note="Description of Artificial Sequence: Synthetic peptide"
MQRASRLKR

SEQ ID NO: 1121 - protein, 8 aa, Artificial Sequence
  source: /note="Description of Artificial Sequence: Synthetic peptide"
QRASRLKR

SEQ ID NO: 1122 - protein, 4 aa, Artificial Sequence
  source: /note="Description of Artificial Sequence: Synthetic peptide"
MQRA

SEQ ID NO: 1123 - protein, 6 aa, Artificial Sequence
  source: /note="Description of Artificial Sequence: Synthetic peptide"
ASRLKR

SEQ ID NO: 1124 - protein, 6 aa, Artificial Sequence
  source: /note="Description of Artificial Sequence: Synthetic peptide"
RASRLK

SEQ ID NO: 1125 - protein, 6 aa, Artificial Sequence
  source: /note="Description of Artificial Sequence: Synthetic peptide"
RLKREL

SEQ ID NO: 1126 - protein, 7 aa, Artificial Sequence
  source: /note="Description of Artificial Sequence: Synthetic peptide"
LHMLATE

SEQ ID NO: 1127 - protein, 4 aa, Artificial Sequence
  source: /note="Description of Artificial Sequence: Synthetic peptide"
LATE

SEQ ID NO: 1128 - protein, 8 aa, Artificial Sequence
  source: /note="Description of Artificial Sequence: Synthetic peptide"
ELHMLATE

SEQ ID NO: 1129 - protein, 5 aa, Artificial Sequence
  source: /note="Description of Artificial Sequence: Synthetic peptide"
MLATE

SEQ ID NO: 1130 - protein, 12 aa, Artificial Sequence
  source: /note="Description of Artificial Sequence: Synthetic peptide"
MAATTGSGVKVP

SEQ ID NO: 1131 - protein, 15 aa, Artificial Sequence
  source: /note="Description of Artificial Sequence: Synthetic peptide"
MAATTGSGVKVPRNF

SEQ ID NO: 1132 - protein, 4 aa, Artificial Sequence
  source: /note="Description of Artificial Sequence: Synthetic peptide"
PRNF

SEQ ID NO: 1133 - protein, 18 aa, Artificial Sequence
  source: /note="Description of Artificial Sequence: Synthetic peptide"
MAATTGSGVKVPRNFRLL

SEQ ID NO: 1134 - protein, 7 aa, Artificial Sequence
  source: /note="Description of Artificial Sequence: Synthetic peptide"
PRNFRLL

SEQ ID NO: 1135 - protein, 19 aa, Artificial Sequence
  source: /note="Description of Artificial Sequence: Synthetic peptide"
MAATTGSGVKVPRNFRLLE

SEQ ID NO: 1136 - protein, 8 aa, Artificial Sequence
  source: /note="Description of Artificial Sequence: Synthetic peptide"
PRNFRLLE

SEQ ID NO: 1137 - protein, 11 aa, Artificial Sequence
  source: /note="Description of Artificial Sequence: Synthetic peptide"
MAATTGSGVKV

SEQ ID NO: 1138 - protein, 14 aa, Artificial Sequence
  source: /note="Description of Artificial Sequence: Synthetic peptide"
MAATTGSGVKVPRN

SEQ ID NO: 1139 - protein, 6 aa, Artificial Sequence
  source: /note="Description of Artificial Sequence: Synthetic peptide"
NFRLLE

SEQ ID NO: 1140 - protein, 4 aa, Artificial Sequence
  source: /note="Description of Artificial Sequence: Synthetic peptide"
LEEG

SEQ ID NO: 1141 - protein, 6 aa, Artificial Sequence
  source: /note="Description of Artificial Sequence: Synthetic peptide"
RNFRLL

SEQ ID NO: 1142 - protein, 6 aa, Artificial Sequence
  source: /note="Description of Artificial Sequence: Synthetic peptide"
RLLEEL

SEQ ID NO: 1143 - protein, 7 aa, Artificial Sequence
  source: /note="Description of Artificial Sequence: Synthetic peptide"
LEEGQKG

SEQ ID NO: 1144 - protein, 4 aa, Artificial Sequence
  source: /note="Description of Artificial Sequence: Synthetic peptide"
GQKG

SEQ ID NO: 1145 - protein, 8 aa, Artificial Sequence
  source: /note="Description of Artificial Sequence: Synthetic peptide"
ELEEGQKG

SEQ ID NO: 1146 - protein, 5 aa, Artificial Sequence
  source: /note="Description of Artificial Sequence: Synthetic peptide"
EGQKG

SEQ ID NO: 1147 - protein, 10 aa, Artificial Sequence
  source: /note="Description of Artificial Sequence: Synthetic peptide"
MAVSTGVKVP

SEQ ID NO: 1148 - protein, 13 aa, Artificial Sequence
  source: /note="Description of Artificial Sequence: Synthetic peptide"
MAVSTGVKVPRNF

SEQ ID NO: 1149 - protein, 5 aa, Artificial Sequence
  source: /note="Description of Artificial Sequence: Synthetic peptide"
RRVSV

SEQ ID NO: 1150 - protein, 16 aa, Artificial Sequence
  source: /note="Description of Artificial Sequence: Synthetic peptide"
MAVSTGVKVPRNFRLL

SEQ ID NO: 1151 - protein, 4 aa, Artificial Sequence
  source: /note="Description of Artificial Sequence: Synthetic peptide"
LSRC

SEQ ID NO: 1152 - protein, 17 aa, Artificial Sequence
  source: /note="Description of Artificial Sequence: Synthetic peptide"
MAVSTGVKVPRNFRLLE

SEQ ID NO: 1153 - protein, 6 aa, Artificial Sequence
  source: /note="Description of Artificial Sequence: Synthetic peptide"
ELNLVR

SEQ ID NO: 1154 - protein, 9 aa, Artificial Sequence
  source: /note="Description of Artificial Sequence: Synthetic peptide"
MAVSTGVKV

SEQ ID NO: 1155 - protein, 12 aa, Artificial Sequence
  source: /note="Description of Artificial Sequence: Synthetic peptide"
MAVSTGVKVPRN

SEQ ID NO: 1156 - protein, 10 aa, Artificial Sequence
  source: /note="Description of Artificial Sequence: Synthetic peptide"
GAVSGSVQAS

SEQ ID NO: 1157 - protein, 6 aa, Artificial Sequence
  source: /note="Description of Artificial Sequence: Synthetic peptide"
ASDRLM

SEQ ID NO: 1158 - protein, 8 aa, Artificial Sequence
  source: /note="Description of Artificial Sequence: Synthetic peptide"
QASDRLMK

SEQ ID NO: 1159 - protein, 15 aa, Artificial Sequence
  source: /note="Description of Artificial Sequence: Synthetic peptide"
GAVSGSVQASDRLMK

SEQ ID NO: 1160 - protein, 7 aa, Artificial Sequence
  source: /note="Description of Artificial Sequence: Synthetic peptide"
QASDRLM

SEQ ID NO: 1161 - protein, 14 aa, Artificial Sequence
  source: /note="Description of Artificial Sequence: Synthetic peptide"
GAVSGSVQASDRLM

SEQ ID NO: 1162 - protein, 4 aa, Artificial Sequence
  source: /note="Description of Artificial Sequence: Synthetic peptide"
QASD

SEQ ID NO: 1163 - protein, 11 aa, Artificial Sequence
  source: /note="Description of Artificial Sequence: Synthetic peptide"
MNSNVENLPPH

SEQ ID NO: 1164 - protein, 14 aa, Artificial Sequence
  source: /note="Description of Artificial Sequence: Synthetic peptide"
MNSNVENLPPHIIR

SEQ ID NO: 1165 - protein, 4 aa, Artificial Sequence
  source: /note="Description of Artificial Sequence: Synthetic peptide"
HIIR

SEQ ID NO: 1166 - protein, 17 aa, Artificial Sequence
  source: /note="Description of Artificial Sequence: Synthetic peptide"
MNSNVENLPPHIIRLVY

SEQ ID NO: 1167 - protein, 7 aa, Artificial Sequence
  source: /note="Description of Artificial Sequence: Synthetic peptide"
HIIRLVY

SEQ ID NO: 1168 - protein, 18 aa, Artificial Sequence
  source: /note="Description of Artificial Sequence: Synthetic peptide"
MNSNVENLPPHIIRLVYK

SEQ ID NO: 1169 - protein, 8 aa, Artificial Sequence
  source: /note="Description of Artificial Sequence: Synthetic peptide"
HIIRLVYK

SEQ ID NO: 1170 - protein, 10 aa, Artificial Sequence
  source: /note="Description of Artificial Sequence: Synthetic peptide"
MNSNVENLPP

SEQ ID NO: 1171 - protein, 13 aa, Artificial Sequence
  source: /note="Description of Artificial Sequence: Synthetic peptide"
MNSNVENLPPHII

SEQ ID NO: 1172 - protein, 6 aa, Artificial Sequence
  source: /note="Description of Artificial Sequence: Synthetic peptide"
IRLVYK

SEQ ID NO: 1173 - protein, 6 aa, Artificial Sequence
  source: /note="Description of Artificial Sequence: Synthetic peptide"
IIRLVY

SEQ ID NO: 1174 - protein, 6 aa, Artificial Sequence
  source: /note="Description of Artificial Sequence: Synthetic peptide"
LVYKEV

SEQ ID NO: 1175 - protein, 7 aa, Artificial Sequence
  source: /note="Description of Artificial Sequence: Synthetic peptide"
VTTLTAD

SEQ ID NO: 1176 - protein, 4 aa, Artificial Sequence
  source: /note="Description of Artificial Sequence: Synthetic peptide"
LTAD

SEQ ID NO: 1177 - protein, 8 aa, Artificial Sequence
  source: /note="Description of Artificial Sequence: Synthetic peptide"
EVTTLTAD

SEQ ID NO: 1178 - protein, 5 aa, Artificial Sequence
  source: /note="Description of Artificial Sequence: Synthetic peptide"
TLTAD

SEQ ID NO: 1179 - protein, 4 aa, Artificial Sequence
  source: /note="Description of Artificial Sequence: Synthetic peptide"
ARGP

SEQ ID NO: 1180 - protein, 7 aa, Artificial Sequence
  source: /note="Description of Artificial Sequence: Synthetic peptide"
ARGPVGK

SEQ ID NO: 1181 - protein, 4 aa, Artificial Sequence
  source: /note="Description of Artificial Sequence: Synthetic peptide"
PVGK

SEQ ID NO: 1182 - protein, 10 aa, Artificial Sequence
  source: /note="Description of Artificial Sequence: Synthetic peptide"
ARGPVGKRLQ

SEQ ID NO: 1183 - protein, 7 aa, Artificial Sequence
  source: /note="Description of Artificial Sequence: Synthetic peptide"
PVGKRLQ

SEQ ID NO: 1184 - protein, 11 aa, Artificial Sequence
  source: /note="Description of Artificial Sequence: Synthetic peptide"
ARGPVGKRLQQ

SEQ ID NO: 1185 - protein, 8 aa, Artificial Sequence
  source: /note="Description of Artificial Sequence: Synthetic peptide"
PVGKRLQQ

SEQ ID NO: 1186 - protein, 6 aa, Artificial Sequence
  source: /note="Description of Artificial Sequence: Synthetic peptide"
ARGPVG

SEQ ID NO: 1187 - protein, 6 aa, Artificial Sequence
  source: /note="Description of Artificial Sequence: Synthetic peptide"
GKRLQQ

SEQ ID NO: 1188 - protein, 6 aa, Artificial Sequence
  source: /note="Description of Artificial Sequence: Synthetic peptide"
VGKRLQ

SEQ ID NO: 1189 - protein, 6 aa, Artificial Sequence
  source: /note="Description of Artificial Sequence: Synthetic peptide"
RLQQEL

SEQ ID NO: 1190 - protein, 7 aa, Artificial Sequence
  source: /note="Description of Artificial Sequence: Synthetic peptide"
LMTLMMS

SEQ ID NO: 1191 - protein, 4 aa, Artificial Sequence
  source: /note="Description of Artificial Sequence: Synthetic peptide"
LMMS

SEQ ID NO: 1192 - protein, 8 aa, Artificial Sequence
  source: /note="Description of Artificial Sequence: Synthetic peptide"
ELMTLMMS

SEQ ID NO: 1193 - protein, 11 aa, Artificial Sequence
  source: /note="Description of Artificial Sequence: Synthetic peptide"
GAVSGSVQASD

SEQ ID NO: 1194 - protein, 6 aa, Artificial Sequence
  source: /note="Description of Artificial Sequence: Synthetic peptide"
MASMQK

SEQ ID NO: 1195 - protein, 4 aa, Artificial Sequence
  source: /note="Description of Artificial Sequence: Synthetic peptide"
SMQK

SEQ ID NO: 1196 - protein, 9 aa, Artificial Sequence
  source: /note="Description of Artificial Sequence: Synthetic peptide"
MASMQKRLQ

SEQ ID NO: 1197 - protein, 7 aa, Artificial Sequence
  source: /note="Description of Artificial Sequence: Synthetic peptide"
SMQKRLQ

SEQ ID NO: 1198 - protein, 10 aa, Artificial Sequence
  source: /note="Description of Artificial Sequence: Synthetic peptide"
MASMQKRLQK

SEQ ID NO: 1199 - protein, 8 aa, Artificial Sequence
  source: /note="Description of Artificial Sequence: Synthetic peptide"
SMQKRLQK

SEQ ID NO: 1200 - protein, 5 aa, Artificial Sequence
  source: /note="Description of Artificial Sequence: Synthetic peptide"
MASMQ

SEQ ID NO: 1201 - protein, 6 aa, Artificial Sequence
  source: /note="Description of Artificial Sequence: Synthetic peptide"
QKRLQK

SEQ ID NO: 1202 - protein, 6 aa, Artificial Sequence
  source: /note="Description of Artificial Sequence: Synthetic peptide"
MQKRLQ

SEQ ID NO: 1203 - protein, 7 aa, Artificial Sequence
  source: /note="Description of Artificial Sequence: Synthetic peptide"
RLQKELL

SEQ ID NO: 1204 - protein, 7 aa, Artificial Sequence
  source: /note="Description of Artificial Sequence: Synthetic peptide"
LLALQND

SEQ ID NO: 1205 - protein, 4 aa, Artificial Sequence
  source: /note="Description of Artificial Sequence: Synthetic peptide"
LQND

SEQ ID NO: 1206 - protein, 8 aa, Artificial Sequence
  source: /note="Description of Artificial Sequence: Synthetic peptide"
ELLALQND

SEQ ID NO: 1207 - protein, 5 aa, Artificial Sequence
  source: /note="Description of Artificial Sequence: Synthetic peptide"
ALQND

SEQ ID NO: 1208 - protein, 6 aa, Artificial Sequence
  source: /note="Description of Artificial Sequence: Synthetic peptide"
AKKFFS

SEQ ID NO: 1209 - protein, 4 aa, Artificial Sequence
  source: /note="Description of Artificial Sequence: Synthetic peptide"
KFFS

SEQ ID NO: 1210 - protein, 9 aa, Artificial Sequence
  source: /note="Description of Artificial Sequence: Synthetic peptide"
AKKFFSTVR

SEQ ID NO: 1211 - protein, 7 aa, Artificial Sequence
  source: /note="Description of Artificial Sequence: Synthetic peptide"
KFFSTVR

SEQ ID NO: 1212 - protein, 10 aa, Artificial Sequence
  source: /note="Description of Artificial Sequence: Synthetic peptide"
AKKFFSTVRK

SEQ ID NO: 1213 - protein, 8 aa, Artificial Sequence
  source: /note="Description of Artificial Sequence: Synthetic peptide"
KFFSTVRK

SEQ ID NO: 1214 - protein, 5 aa, Artificial Sequence
  source: /note="Description of Artificial Sequence: Synthetic peptide"
AKKFF

SEQ ID NO: 1215 - protein, 6 aa, Artificial Sequence
  source: /note="Description of Artificial Sequence: Synthetic peptide"
FSTVRK

SEQ ID NO: 1216 - protein, 6 aa, Artificial Sequence
  source: /note="Description of Artificial Sequence: Synthetic peptide"
FFSTVR

SEQ ID NO: 1217 - protein, 7 aa, Artificial Sequence
  source: /note="Description of Artificial Sequence: Synthetic peptide"
TVRKEMA

SEQ ID NO: 1218 - protein, 7 aa, Artificial Sequence
  source: /note="Description of Artificial Sequence: Synthetic peptide"
MALLATS

SEQ ID NO: 1219 - protein, 4 aa, Artificial Sequence
  source: /note="Description of Artificial Sequence: Synthetic peptide"
LATS

SEQ ID NO: 1220 - protein, 8 aa, Artificial Sequence
  source: /note="Description of Artificial Sequence: Synthetic peptide"
EMALLATS

SEQ ID NO: 1221 - protein, 5 aa, Artificial Sequence
  source: /note="Description of Artificial Sequence: Synthetic peptide"
LLATS

SEQ ID NO: 1222 - protein, 8 aa, Artificial Sequence
  source: /note="Description of Artificial Sequence: Synthetic peptide"
ANDANSAA

SEQ ID NO: 1223 - protein, 11 aa, Artificial Sequence
  source: /note="Description of Artificial Sequence: Synthetic peptide"
ANDANSAARAR

SEQ ID NO: 1224 - protein, 4 aa, Artificial Sequence
  source: /note="Description of Artificial Sequence: Synthetic peptide"
ARAR

SEQ ID NO: 1225 - protein, 14 aa, Artificial Sequence
  source: /note="Description of Artificial Sequence: Synthetic peptide"
ANDANSAARARRLA

SEQ ID NO: 1226 - protein, 7 aa, Artificial Sequence
  source: /note="Description of Artificial Sequence: Synthetic peptide"
ARARRLA

SEQ ID NO: 1227 - protein, 15 aa, Artificial Sequence
  source: /note="Description of Artificial Sequence: Synthetic peptide"
ANDANSAARARRLAQ

SEQ ID NO: 1228 - protein, 8 aa, Artificial Sequence
  source: /note="Description of Artificial Sequence: Synthetic peptide"
ARARRLAQ

SEQ ID NO: 1229 - protein, 7 aa, Artificial Sequence
  source: /note="Description of Artificial Sequence: Synthetic peptide"
ANDANSA

SEQ ID NO: 1230 - protein, 10 aa, Artificial Sequence
  source: /note="Description of Artificial Sequence: Synthetic peptide"
ANDANSAARA

SEQ ID NO: 1231 - protein, 6 aa, Artificial Sequence
  source: /note="Description of Artificial Sequence: Synthetic peptide"
ARRLAQ

SEQ ID NO: 1232 - protein, 6 aa, Artificial Sequence
  source: /note="Description of Artificial Sequence: Synthetic peptide"
RARRLA

SEQ ID NO: 1233 - protein, 6 aa, Artificial Sequence
  source: /note="Description of Artificial Sequence: Synthetic peptide"
RLAQEA

SEQ ID NO: 1234 - protein, 7 aa, Artificial Sequence
  source: /note="Description of Artificial Sequence: Synthetic peptide"
AVTLSTS

SEQ ID NO: 1235 - protein, 4 aa, Artificial Sequence
  source: /note="Description of Artificial Sequence: Synthetic peptide"
LSTS

SEQ ID NO: 1236 - protein, 8 aa, Artificial Sequence
  source: /note="Description of Artificial Sequence: Synthetic peptide"
EAVTLSTS

SEQ ID NO: 1237 - protein, 5 aa, Artificial Sequence
  source: /note="Description of Artificial Sequence: Synthetic peptide"
TLSTS

SEQ ID NO: 1238 - protein, 5 aa, Artificial Sequence
  source: /note="Description of Artificial Sequence: Synthetic peptide"
MAASR

SEQ ID NO: 1239 - protein, 4 aa, Artificial Sequence
  source: /note="Description of Artificial Sequence: Synthetic peptide"
AASR

SEQ ID NO: 1240 - protein, 8 aa, Artificial Sequence
  source: /note="Description of Artificial Sequence: Synthetic peptide"
MAASRRLM

SEQ ID NO: 1241 - protein, 7 aa, Artificial Sequence
  source: /note="Description of Artificial Sequence: Synthetic peptide"
AASRRLM

SEQ ID NO: 1242 - protein, 9 aa, Artificial Sequence
  source: /note="Description of Artificial Sequence: Synthetic peptide"
MAASRRLMK

SEQ ID NO: 1243 - protein, 8 aa, Artificial Sequence
  source: /note="Description of Artificial Sequence: Synthetic peptide"
AASRRLMK

SEQ ID NO: 1244 - protein, 4 aa, Artificial Sequence
  source: /note="Description of Artificial Sequence: Synthetic peptide"
MAAS

SEQ ID NO: 1245 - protein, 6 aa, Artificial Sequence
  source: /note="Description of Artificial Sequence: Synthetic peptide"
SRRLMK

SEQ ID NO: 1246 - protein, 6 aa, Artificial Sequence
  source: /note="Description of Artificial Sequence: Synthetic peptide"
ASRRLM

SEQ ID NO: 1247 - protein, 6 aa, Artificial Sequence
  source: /note="Description of Artificial Sequence: Synthetic peptide"
RLMKEL

SEQ ID NO: 1248 - protein, 7 aa, Artificial Sequence
  source: /note="Description of Artificial Sequence: Synthetic peptide"
LEEIRKC

SEQ ID NO: 1249 - protein, 4 aa, Artificial Sequence
  source: /note="Description of Artificial Sequence: Synthetic peptide"
IRKC

SEQ ID NO: 1250 - protein, 8 aa, Artificial Sequence
  source: /note="Description of Artificial Sequence: Synthetic peptide"
ELEEIRKC

SEQ ID NO: 1251 - protein, 5 aa, Artificial Sequence
  source: /note="Description of Artificial Sequence: Synthetic peptide"
EIRKC

SEQ ID NO: 1252 - protein, 5 aa, Artificial Sequence
  source: /note="Description of Artificial Sequence: Synthetic peptide"
MMASM

SEQ ID NO: 1253 - protein, 4 aa, Artificial Sequence
  source: /note="Description of Artificial Sequence: Synthetic peptide"
MASM

SEQ ID NO: 1254 - protein, 8 aa, Artificial Sequence
  source: /note="Description of Artificial Sequence: Synthetic peptide"
MMASMRVV

SEQ ID NO: 1255 - protein, 7 aa, Artificial Sequence
  source: /note="Description of Artificial Sequence: Synthetic peptide"
MASMRVV

SEQ ID NO: 1256 - protein, 9 aa, Artificial Sequence
  source: /note="Description of Artificial Sequence: Synthetic peptide"
MMASMRVVK

SEQ ID NO: 1257 - protein, 8 aa, Artificial Sequence
  source: /note="Description of Artificial Sequence: Synthetic peptide"
MASMRVVK

SEQ ID NO: 1258 - protein, 4 aa, Artificial Sequence
  source: /note="Description of Artificial Sequence: Synthetic peptide"
MMAS

SEQ ID NO: 1259 - protein, 6 aa, Artificial Sequence
  source: /note="Description of Artificial Sequence: Synthetic peptide"
SMRVVK

SEQ ID NO: 1260 - protein, 6 aa, Artificial Sequence
  source: /note="Description of Artificial Sequence: Synthetic peptide"
ASMRVV

SEQ ID NO: 1261 - protein, 6 aa, Artificial Sequence
  source: /note="Description of Artificial Sequence: Synthetic peptide"
RVVKEL

SEQ ID NO: 1262 - protein, 7 aa, Artificial Sequence
  source: /note="Description of Artificial Sequence: Synthetic peptide"
LEDLQKK

SEQ ID NO: 1263 - protein, 4 aa, Artificial Sequence
  source: /note="Description of Artificial Sequence: Synthetic peptide"
LQKK

SEQ ID NO: 1264 - protein, 8 aa, Artificial Sequence
  source: /note="Description of Artificial Sequence: Synthetic peptide"
ELEDLQKK

SEQ ID NO: 1265 - protein, 5 aa, Artificial Sequence
  source: /note="Description of Artificial Sequence: Synthetic peptide"
DLQKK

SEQ ID NO: 1266 - protein, 4 aa, Artificial Sequence
  source: /note="Description of Artificial Sequence: Synthetic peptide"
GPFY

SEQ ID NO: 1267 - protein, 7 aa, Artificial Sequence
  source: /note="Description of Artificial Sequence: Synthetic peptide"
GPFYLEY

SEQ ID NO: 1268 - protein, 4 aa, Artificial Sequence
  source: /note="Description of Artificial Sequence: Synthetic peptide"
YLEY

SEQ ID NO: 1269 - protein, 10 aa, Artificial Sequence
  source: /note="Description of Artificial Sequence: Synthetic peptide"
GPFYLEYSLL

SEQ ID NO: 1270 - protein, 7 aa, Artificial Sequence
  source: /note="Description of Artificial Sequence: Synthetic peptide"
YLEYSLL

SEQ ID NO: 1271 - protein, 11 aa, Artificial Sequence
  source: /note="Description of Artificial Sequence: Synthetic peptide"
GPFYLEYSLLA

SEQ ID NO: 1272 - protein, 8 aa, Artificial Sequence
  source: /note="Description of Artificial Sequence: Synthetic peptide"
YLEYSLLA

SEQ ID NO: 1273 - protein, 6 aa, Artificial Sequence
  source: /note="Description of Artificial Sequence: Synthetic peptide"
GPFYLE

SEQ ID NO: 1274 - protein, 6 aa, Artificial Sequence
  source: /note="Description of Artificial Sequence: Synthetic peptide"
EYSLLA

SEQ ID NO: 1275 - protein, 6 aa, Artificial Sequence
  source: /note="Description of Artificial Sequence: Synthetic peptide"
LEYSLL

SEQ ID NO: 1276 - protein, 6 aa, Artificial Sequence
  source: /note="Description of Artificial Sequence: Synthetic peptide"
SLLAEF

SEQ ID NO: 1277 - protein, 7 aa, Artificial Sequence
  source: /note="Description of Artificial Sequence: Synthetic peptide"
FTLVVKQ

SEQ ID NO: 1278 - protein, 4 aa, Artificial Sequence
  source: /note="Description of Artificial Sequence: Synthetic peptide"
VVKQ

SEQ ID NO: 1279 - protein, 8 aa, Artificial Sequence
  source: /note="Description of Artificial Sequence: Synthetic peptide"
EFTLVVKQ

SEQ ID NO: 1280 - protein, 5 aa, Artificial Sequence
  source: /note="Description of Artificial Sequence: Synthetic peptide"
LVVKQ

SEQ ID NO: 1281 - protein, 8 aa, Artificial Sequence
  source: /note="Description of Artificial Sequence: Synthetic peptide"
GAVSGSVQ

SEQ ID NO: 1282 - protein, 11 aa, Artificial Sequence
  source: /note="Description of Artificial Sequence: Synthetic peptide"
GAVSGSVQATD

SEQ ID NO: 1283 - protein, 4 aa, Artificial Sequence
  source: /note="Description of Artificial Sequence: Synthetic peptide"
QATD

SEQ ID NO: 1284 - protein, 14 aa, Artificial Sequence
  source: /note="Description of Artificial Sequence: Synthetic peptide"
GAVSGSVQATDRLM

SEQ ID NO: 1285 - protein, 7 aa, Artificial Sequence
  source: /note="Description of Artificial Sequence: Synthetic peptide"
QATDRLM

SEQ ID NO: 1286 - protein, 15 aa, Artificial Sequence
  source: /note="Description of Artificial Sequence: Synthetic peptide"
GAVSGSVQATDRLMK

SEQ ID NO: 1287 - protein, 6 aa, Artificial Sequence
  source: /note="Description of Artificial Sequence: Synthetic peptide"
HRDFCD

SEQ ID NO: 1288 - protein, 7 aa, Artificial Sequence
  source: /note="Description of Artificial Sequence: Synthetic peptide"
GAVSGSV

SEQ ID NO: 1289 - protein, 6 aa, Artificial Sequence
  source: /note="Description of Artificial Sequence: Synthetic peptide"
LMKEAA

SEQ ID NO: 1290 - protein, 6 aa, Artificial Sequence
  source: /note="Description of Artificial Sequence: Synthetic peptide"
LKQDYL

SEQ ID NO: 1291 - protein, 6 aa, Artificial Sequence
  source: /note="Description of Artificial Sequence: Synthetic peptide"
TDRLMK

SEQ ID NO: 1292 - protein, 6 aa, Artificial Sequence
  source: /note="Description of Artificial Sequence: Synthetic peptide"
IIKETQ

SEQ ID NO: 1293 - protein, 6 aa, Artificial Sequence
  source: /note="Description of Artificial Sequence: Synthetic peptide"
LKRELH

SEQ ID NO: 1294 - protein, 7 aa, Artificial Sequence
  source: /note="Description of Artificial Sequence: Synthetic peptide"
LRDIYRS

SEQ ID NO: 1295 - protein, 4 aa, Artificial Sequence
  source: /note="Description of Artificial Sequence: Synthetic peptide"
IYRS

SEQ ID NO: 1296 - protein, 8 aa, Artificial Sequence
  source: /note="Description of Artificial Sequence: Synthetic peptide"
ELRDIYRS

SEQ ID NO: 1297 - protein, 5 aa, Artificial Sequence
  source: /note="Description of Artificial Sequence: Synthetic peptide"
DIYRS

SEQ ID NO: 1298 - protein, 6 aa, Artificial Sequence
  source: /note="Description of Artificial Sequence: Synthetic peptide"
LLEELE

SEQ ID NO: 1299 - protein, 6 aa, Artificial Sequence
  source: /note="Description of Artificial Sequence: Synthetic peptide"
VYKEVT

SEQ ID NO: 1300 - protein, 6 aa, Artificial Sequence
  source: /note="Description of Artificial Sequence: Synthetic peptide"
LQQELM

SEQ ID NO: 1301 - protein, 6 aa, Artificial Sequence
  source: /note="Description of Artificial Sequence: Synthetic peptide"
LQKELL

SEQ ID NO: 1302 - protein, 6 aa, Artificial Sequence
  source: /note="Description of Artificial Sequence: Synthetic peptide"
VRKEMA

SEQ ID NO: 1303 - protein, 6 aa, Artificial Sequence
  source: /note="Description of Artificial Sequence: Synthetic peptide"
LAQEAV

SEQ ID NO: 1304 - protein, 6 aa, Artificial Sequence
  source: /note="Description of Artificial Sequence: Synthetic peptide"
LMKELE

SEQ ID NO: 1305 - protein, 4 aa, Artificial Sequence
  source: /note="Description of Artificial Sequence: Synthetic peptide"
GQAT

SEQ ID NO: 1306 - protein, 6 aa, Artificial Sequence
  source: /note="Description of Artificial Sequence: Synthetic peptide"
VVKELE

SEQ ID NO: 1307 - protein, 6 aa, Artificial Sequence
  source: /note="Description of Artificial Sequence: Synthetic peptide"
LLAEFT

SEQ ID NO: 1308 - protein, 6 aa, Artificial Sequence
  source: /note="Description of Artificial Sequence: Synthetic peptide"
LMKELR

SEQ ID NO: 1309 - protein, 10 aa, Artificial Sequence
  source: /note="Description of Artificial Sequence: Synthetic peptide"
GAVSGSVQAT

SEQ ID NO: 1310 - protein, 5 aa, Artificial Sequence
  source: /note="Description of Artificial Sequence: Synthetic peptide"
DIYRS

SEQ ID NO: 1311 - protein, 8 aa, Artificial Sequence
  source: /note="Description of Artificial Sequence: Synthetic peptide"
ELRDIYRS

SEQ ID NO: 1312 - protein, 6 aa, Artificial Sequence
  source: /note="Description of Artificial Sequence: Synthetic peptide"
ATDRLM

SEQ ID NO: 1313 - protein, 7 aa, Artificial Sequence
  source: /note="Description of Artificial Sequence: Synthetic peptide"
GAVSGSV

SEQ ID NO: 1314 - protein, 8 aa, Artificial Sequence
  source: /note="Description of Artificial Sequence: Synthetic peptide"
QATDRLMK

SEQ ID NO: 1315 - protein, 4 aa, Artificial Sequence
  source: /note="Description of Artificial Sequence: Synthetic peptide"
TSAK

SEQ ID NO: 1316 - protein, 4 aa, Artificial Sequence
  source: /note="Description of Artificial Sequence: Synthetic peptide"
ITLD

SEQ ID NO: 1317 - protein, 4 aa, Artificial Sequence
  source: /note="Description of Artificial Sequence: Synthetic peptide"
TSAK

SEQ ID NO: 1318 - protein, 4 aa, Artificial Sequence
  source: /note="Description of Artificial Sequence: Synthetic peptide"
ITLD

SEQ ID NO: 1319 - protein, 5 aa, Artificial Sequence
  source: /note="Description of Artificial Sequence: Synthetic peptide"
TLMMS

SEQ ID NO: 1320 - protein, 6 aa, Artificial Sequence
  source: /note="Description of Artificial Sequence: Synthetic peptide"
SDRLMK

SEQ ID NO: 1321 - protein, 17 aa, Artificial Sequence
  source: /note="Description of Artificial Sequence: Synthetic peptide"
MSTPARRRLMRDFKRLQ

SEQ ID NO: 1322 - protein, 17 aa, Artificial Sequence
  source: /note="Description of Artificial Sequence: Synthetic peptide"
  MOD_RES (5)..(5): S-pentenyl alanine
  MOD_RES (10)..(10): Norleucine
  MOD_RES (12)..(12): R-octenyl alanine
ASTPXRRRLXRXFKRLQ

SEQ ID NO: 1323 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XATPXRRRLXRXFKRLQ

SEQ ID NO: 1324 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XSAPXRRRLXRXFKRLQ

SEQ ID NO: 1325 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XSTAXRRRLXRXFKRLQ

SEQ ID NO: 1326 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XSTPXARRLXRXFKRLQ

SEQ ID NO: 1327 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XSTPXRARLXRXFKRLQ

SEQ ID NO: 1328 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XSTPXRRALXRXFKRLQ

SEQ ID NO: 1329 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XSTPXRRRAXRXFKRLQ

SEQ ID NO: 1330 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (12)..(12): R-octenyl alanine
XSTPXRRRLARXFKRLQ

SEQ ID NO: 1331 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XSTPXRRRLXAXFKRLQ

SEQ ID NO: 1332 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XSTPXRRRLXRXAKRLQ

SEQ ID NO: 1333 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XSTPXRRRLXRXFARLQ

SEQ ID NO: 1334 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XSTPXRRRLXRXFKALQ

SEQ ID NO: 1335 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XSTPXRRRLXRXFKRAQ

SEQ ID NO: 1336 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XSTPXRRRLXRXFKRLA

SEQ ID NO: 1337 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XSTPXERRLXRXFKRLQ

SEQ ID NO: 1338 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XSTPXRERLXRXFKRLQ

SEQ ID NO: 1339 - protein, 17 aa, Artificial Sequence
  source: /note="Description of Artificial Sequence: Synthetic peptide"
  MOD_RES (1)..(1): Norleucine
  MOD_RES (5)..(5): S-pentenyl alanine
  MOD_RES (10)..(10): Norleucine
  MOD_RES (12)..(12): R-octenyl alanine
XSTPXRRELXRXFKRLQ

SEQ ID NO: 1340 - protein, 19 aa, Artificial Sequence
  source: /note="Description of Artificial Sequence: Synthetic peptide"
  MOD_RES (1)..(1): Norleucine
  MOD_RES (19)..(19): Biotinylated Lysine
XPSSASRQLLRKQLKEIQX

SEQ ID NO: 1341 - protein, 18 aa, Artificial Sequence
  source: /note="Description of Artificial Sequence: Synthetic peptide"
  MOD_RES (1)..(1): Norleucine
XPSSASRQLLRKQLKEIQ

SEQ ID NO: 1342 - protein, 18 aa, Artificial Sequence
  source: /note="Description of Artificial Sequence: Synthetic peptide"
  MOD_RES (1)..(1): Norleucine
  MOD_RES (10)..(10): Norleucine
  MOD_RES (18)..(18): Biotinylated Lysine
XSTPARRRLXRDFKRLQX

SEQ ID NO: 1343 - protein, 17 aa, Artificial Sequence
  source: /note="Description of Artificial Sequence: Synthetic peptide"
  MOD_RES (1)..(1): Norleucine
  MOD_RES (10)..(10): Norleucine
XSTPARRRLXRDFKRLQ

SEQ ID NO: 1344 - protein, 19 aa, Artificial Sequence
  source: /note="Description of Artificial Sequence: Synthetic peptide"
  MOD_RES (1)..(1): Norleucine
  MOD_RES (6)..(6): R-octenyl alanine
  MOD_RES (13)..(13): S-pentenyl alanine
XPSSAXRQLLRKXLKEIQK

SEQ ID NO: 1345 - protein, 17 aa, Artificial Sequence
  source: /note="Description of Artificial Sequence: Synthetic peptide"
  MOD_RES (1)..(1): Norleucine
  MOD_RES (2)..(2): R-octenyl alanine
  MOD_RES (9)..(9): S-pentenyl alanine
XXLKRIHKXLNDLARDK

SEQ ID NO: 1346 - protein, 15 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XAGTXLKRLXAXYKK

SEQ ID NO: 1347 - protein, 18 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXARRLXRXFKRLQK

SEQ ID NO: 1348 - protein, 18 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRARLXRXFKRLQK

SEQ ID NO: 1349 - protein, 18 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRRALXRXFKRLQK

SEQ ID NO: 1350 - protein, 18 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXERRLXRXFKRLQK

SEQ ID NO: 1351 - protein, 18 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRERLXRXFKRLQK

SEQ ID NO: 1352 - protein, 18 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRRELXRXFKRLQK

SEQ ID NO: 1353 - protein, 18 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (12)..(12): S-pentenyl alanine
XSTPXRARAARXFKRLQK

SEQ ID NO: 1354 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (12)..(12): S-pentenyl alanine
XSTPXRARAARXFKRLQ

SEQ ID NO: 1355 - protein, 18 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTPXRRELXEXFKRLQK

SEQ ID NO: 1356 - protein, 18 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
XSTAXERELXEXFAALQK

SEQ ID NO: 1357 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (12)..(12): S-pentenyl alanine
XSTPXRRRLCRXFKRLQ

SEQ ID NO: 1358 - protein, 18 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (12)..(12): S-pentenyl alanine
XSTPXRRRLCRXFKRLQK

SEQ ID NO: 1359 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Diamino butanoic acid terminating in bromoacetyl
  MOD_RES (12)..(12): S-pentenyl alanine
XSTPXRRRLXRXFKRLQ

SEQ ID NO: 1360 - protein, 17 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
  MOD_RES (14)..(14): Diamino butanoic acid terminating in bromoacetyl
XSTPXRRRLXRXFXRLQ

SEQ ID NO: 1361 - protein, 18 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
  MOD_RES (16)..(16): Non-natural benzophenone-containing amino acid
  MOD_RES (18)..(18): Biotinylated Lysine
XSTPXRRRLXRXFKRXQX

SEQ ID NO: 1362 - protein, 18 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
  MOD_RES (13)..(13): Non-natural benzophenone-containing amino acid
  MOD_RES (18)..(18): Biotinylated Lysine
XSTPXRRRLXRXXAALQX

SEQ ID NO: 1363 - protein, 18 aa, Artificial Sequence
  source: /note="Description of Artificial Sequence: Synthetic peptide"
  MOD_RES (1)..(1): Non-natural benzophenone-containing amino acid
  MOD_RES (5)..(5): R-octenyl alanine
  MOD_RES (10)..(10): Norleucine
  MOD_RES (12)..(12): S-pentenyl alanine
  MOD_RES (18)..(18): Biotinylated Lysine
XSTPXRRRLXRXFKRLQX

SEQ ID NO: 1364 - protein, 18 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Non-natural benzophenone-containing amino acid
  MOD_RES (12)..(12): S-pentenyl alanine
  MOD_RES (18)..(18): Biotinylated Lysine
XSTPXRRRLXRXFKRLQX

SEQ ID NO: 1365 - protein, 18 aa, Artificial Sequence
  source: /note="Description of Artificial Sequence: Synthetic peptide"
  MOD_RES (1)..(1): Norleucine
  MOD_RES (5)..(5): R-octenyl alanine
  MOD_RES (10)..(10): Norleucine
  MOD_RES (12)..(12): S-pentenyl alanine
  MOD_RES (13)..(13): Non-natural benzophenone-containing amino acid
  MOD_RES (18)..(18): Biotinylated Lysine
XSTPXRRRLXRXXKRLQX

What is claimed is:

1. A peptide or a salt thereof comprising the amino acid sequence of SEQ ID NO:132 with 0 to 3 amino acid substitutions, wherein the amino acid substitutions, if present, are not at positions 5 and 12 of SEQ ID NO:132, wherein positions 5 and 12 of SEQ ID NO: 132 are internally cross-linked, wherein (a) position 5 of SEQ ID NO:132 is S-pentenyl alanine and position 12 of SEQ ID NO: 132 is R-octenyl alanine, or (b) position 5 of SEQ ID NO: 132 is R-octenyl alanine and position 12 of SEQ ID NO: 132 is S-pentenyl alanine, and wherein the peptide or the salt thereof inhibits a human E1-mediated thioester transfer to a human E2.

2. The peptide or the salt thereof of claim 1, wherein the peptide or the salt thereof comprises the amino acid sequence of SEQ ID NO:132 with 1 to 3 amino acid substitutions.

3. The peptide or the salt thereof of claim 2, wherein the peptide or the salt thereof is 17 to 25 amino acids in length.

4. The peptide or the salt thereof of claim 2, wherein the peptide or the salt thereof is 17 amino acids in length.

5. The peptide or the salt thereof of claim 2, wherein the 1 to 3 amino acid substitutions are not at any of positions 7, 9, 10, 13, and 16 of SEQ ID NO:132.

6. The peptide or the salt thereof of claim 5, wherein the 1 to 3 amino acid substitutions are selected from: alanine at one or more of positions 1, 2, 3, 4, 6, 8, 11, 14, 15, and 17 of SEQ ID NO: 132, or glutamic acid at one or both of positions 6 and 8 of SEQ ID NO: 132.

7. The peptide or the salt thereof of claim 6, wherein the peptide or the salt thereof is 17 to 25 amino acids in length.

8. The peptide or the salt thereof of claim 2, wherein the 1 to 3 amino acid substitutions are not at any of positions 7, 9, 10, 13, 15, and 16 of SEQ ID NO:132.

9. The peptide or the salt thereof of claim 8, wherein the 1 to 3 amino acid substitutions are selected from: alanine at one or more of positions 1, 2, 3, 4, 6, 8, 11, 14, and 17 of SEQ ID NO: 132, or glutamic acid at one or both of positions 6 and 8 of SEQ ID NO:132.

10. The peptide or the salt thereof of claim 9, wherein the peptide or the salt thereof is 17 to 25 amino acids in length.

11. The peptide or the salt thereof of claim 1, wherein the peptide or the salt thereof comprises the amino acid sequence of SEQ ID NO:132 with 1 amino acid substitution.

12. The peptide or the salt thereof of claim 11, wherein the 1 amino acid substitution is not at any of positions 7, 9, 10, 13, and 16 of SEQ ID NO: 132.

13. The peptide or the salt thereof of claim 11, wherein the 1 amino acid substitution is not at any of positions 7, 9, 10, 13, 15, and 16 of SEQ ID NO: 132.

14. The peptide or the salt thereof of claim 11, wherein the 1 amino acid substitution is selected from: alanine at one of positions 1, 2, 3, 4, 6, 8, 11, 14, 15, and 17 of SEQ ID NO: 132, or glutamic acid at one of positions 6 and 8 of SEQ ID NO:132.

15. The peptide or the salt thereof of claim 11, wherein the peptide or the salt thereof is 17 to 25 amino acids in length.

16. A pharmaceutical composition comprising the peptide or the salt thereof of claim 1, and a pharmaceutically acceptable carrier.

17. A pharmaceutical composition comprising the peptide or the salt thereof of claim 11, and a pharmaceutically acceptable carrier.

18. A peptide or a salt thereof comprising the amino acid sequence of SEQ ID NO:132, wherein position 5 of SEQ ID NO:132 is S-pentenyl alanine and position 12 of SEQ ID NO:132 is R-octenyl alanine, and wherein position 5 of SEQ ID NO:132 is cross-linked to position 12 of SEQ ID NO:132.

19. The peptide or the salt thereof of claim 18, wherein the peptide or the salt thereof consists of the sequence of SEQ ID NO: 132, wherein position 5 of SEQ ID NO: 132 is S-pentenyl alanine and position 12 of SEQ ID NO:132 is R-octenyl alanine, and wherein position 5 of SEQ ID NO: 132 is cross-linked to position 12 of SEQ ID NO: 132.

20. The peptide or the salt thereof of claim 18, wherein the peptide or the salt thereof is 17 to 25 amino acids in length.

21. A pharmaceutical composition comprising the peptide or the salt thereof of claim 18, and a pharmaceutically acceptable carrier.

22. A pharmaceutical composition comprising the peptide or the salt thereof of claim 19, and a pharmaceutically acceptable carrier.

23. A peptide or a salt thereof comprising the amino acid sequence of SEQ ID NO: 132, wherein position 5 of SEQ ID NO:132 is R-octenyl alanine and position 12 of SEQ ID NO: 132 is S-pentenyl alanine, and wherein position 5 of SEQ ID NO:132 is cross-linked to position 12 of SEQ ID NO:132.

24. The peptide or the salt thereof of claim 23, wherein the peptide or the salt thereof consists of the amino acid sequence of SEQ ID NO: 132, wherein position 5 of SEQ ID NO: 132 is R-octenyl alanine and position 12 of SEQ ID NO:132 is S-pentenyl alanine, and wherein position 5 of SEQ ID NO:132 is cross-linked to position 12 of SEQ ID NO: 132.

25. The peptide or the salt thereof of claim 23, wherein the peptide or the salt thereof is 17 to 25 amino acids in length.

26. A pharmaceutical composition comprising the peptide or the salt thereof of claim 23, and a pharmaceutically acceptable carrier.

27. A pharmaceutical composition comprising the peptide or the salt thereof of claim 24, and a pharmaceutically acceptable carrier.

28. A method of making a structurally stabilized peptide, the method comprising:
(i) providing a peptide comprising the amino acid sequence of SEQ ID NO: 132 with 0 to 3 amino acid substitutions, wherein the amino acid substitutions, if present, are not at positions 5 and 12 of SEQ ID NO:132, wherein (a) position 5 of SEQ ID NO: 132 is S-pentenyl alanine and position 12 of SEQ ID NO:132 is R-octenyl alanine, or (b) position 5 of SEQ ID NO:132 is R-octenyl alanine and position 12 of SEQ ID NO: 132 is S-pentenyl alanine, wherein the peptide inhibits a human E1-mediated thioester transfer to a human E2; and
(ii) cross-linking the amino acids at positions 5 and 12 of SEQ ID NO:132.

\* \* \* \* \*

UNITED STATES PATENT AND TRADEMARK OFFICE
CERTIFICATE OF CORRECTION

PATENT NO. : 12,358,960 B2
APPLICATION NO. : 17/600468
DATED : July 15, 2025
INVENTOR(S) : Loren D. Walensky, Ann Morgan Cathcart and Gregory H. Bird Page 1 of 1

It is certified that error appears in the above-identified patent and that said Letters Patent is hereby corrected as shown below:

In the Specification

Column 1, Line 9:
Delete: "This application claims the benefit of priority of U.S. Provisional Application No. 62/835,721, filed Apr. 18, 2019, the contents of which are incorporated by reference herein in their entirety."

And Replace with:
-- This application is a U.S. National Stage application, and claims priority of International Application No. PCT/US2020/028840, filed April 17, 2020, which claims the benefit of priority of U.S. Provisional Application No. 62/835,721, filed April 18, 2019, the contents of which are incorporated by reference herein in their entirety. --

Column 1, Line 17:
Delete: "This application is a U.S. National Stage application, and claims priority of International Application No. PCT/US2020/028840, filed Apr. 17, 2020, which claims the benefit of priority of U.S. Provisional Application No. 62/835,721, filed Apr. 18, 2019, the contents of which are incorporated by reference herein in their entirety."

And Replace with:
-- This invention was made with government support under grant numbers R35 CA197583 and F30 CA221087 awarded by The National Institutes of Health. The government has certain rights in the invention. --

Signed and Sealed this
Second Day of September, 2025

Coke Morgan Stewart
*Acting Director of the United States Patent and Trademark Office*